United States Patent 8,101,349 (GENE PRODUCTS DIFFERENTIALLY EXPRESSED IN CANCEROUS CELLS AND THEIR METHODS OF USE II) - sequence listing, part 6

SEQ ID NO: 22711 - DNA, 677 bp, Homo sapiens
  misc_feature 6, 8, 138, 144, 151, 161, 164, 172, 174, 183, 185, 186, 187,192, 202, 205, 207, 210, 217, 226, 233, 246, 248, 249, 253,259, 276, 284, 365, 376, 387, 407, 438, 482, 487, 521, 536,542, 543, 552, 567, 587, 597, 600, 605, 607, 621: n = A,T,C or G
  misc_feature 626, 660, 664, 671, 672, 674, 676: n = A,T,C or G
gacagnangggatttgtttgtgttgggaacatttcaaatcttctcttctagctattttgaaatatataataaattatataataatcctgtgtgtaactttttgagaaactgtcaagcttttttttttttacagggatngaatcnttatacnttttccccancantaaacaancnttccaattngnnnccacntttttgccancantnatnattttcnagtttttcnattatanccatcctgggggngnnaagngcaggnggcttctttttattagnccattccnggtttccactcaaggaaaaggcccttttaatgtaaaaggaaacccaggcccaccttattatgctagctattaaaaaaaaantctccaagganatagattccanaagggcctctgcagggcagnactcccttctggaacccaaggctttactctnttggccagcatctgagctccccactctagggggggggggttganggggngttttaccctctgaggggctcacttacagccctntctccttgaaaatgnaatganntgggggccntggagaaatgcttgnaaaaaggaactaaagctttntggaaaacanaanaaccncntaaatccttctttnttcanaaaaatggttgcctcctgattatagcggggaccncctnggggctnngnanc

SEQ ID NO: 22712 - DNA, 719 bp, Homo sapiens
  misc_feature 19, 20, 467, 590, 614, 625, 639, 689: n = A,T,C or G
ggttttccactccaccagnnatgaaaattaaattgacttgtcactattttctcctcatataggcattcatcttgctcagggctttatttcttcaaattattccaatggcttacttaacagatgtagtttctttcttagttaagtcaaaaggtatttattgagcaagtactgctaatactaccactgctactgctggtactgttaatactactgtctctactactgcaatgactggtctcatagtgttttaggctgccttcaaggtgcatcaccttatttaaattgtacaacaaacccttaagttatgtacaattatatgaggaactaggtctcaaaagttttataatttcctccagctcgtagtggcagggctggactccaagctgagatgtgtctggttgtccggttctaaacctttctacaggtcaccttgtaaagaataaggatggagctcaaacacagatacntaaaggaataaaattaaaacttggtcctgcttttaaatgtagtgggtgaaaagccagaagtataaataactccagttctgtataaatgatattctcaaatgctgcatcagaatcgcttggganaattattaaaacatggattcctanactgcaccaanaactcttggatganactaaaggatttgtaaaaaaaaaaaaaaaaaacccggggcccttttccgnaacccaatgaaaaactgggagtgccccccc

SEQ ID NO: 22713 - DNA, 449 bp, Homo sapiens
  misc_feature 282, 300, 307, 356, 369, 380, 418, 431, 434, 439, 440, 442: n = A,T,C or G
ggggtttgtaggctgtgtgacagatctatactgatatttttatatgtagatagaagccatggttagtaacaaaatatgtagtttttttctaacataaatactactattatatgcatgtctggagattattttaatatttaaaaatgactccccatatgggcaaatgttgggttcactgatccgcaataagcatttcaataaaatatctcatctgtttaaggaatatgttgggaaggacagatagtactttttttcatcttgagatttgtttgacacatttanatgcattcattgattttnctcattntaaggggtaatacctttgatctccctggggtttgtagagatctttgttnttagtagaatggngtctgcacacncaaaaaaaaaaaaaaaaaaacccttgggccttttttcntaacccactttantcnttgtnntnccccccc

SEQ ID NO: 22714 - DNA, 828 bp, Homo sapiens
  misc_feature 2, 7, 8, 13, 14, 16, 17, 19, 24, 25, 31, 44, 60, 63, 71,73, 98, 105, 672, 686, 697, 726, 735, 738, 756, 757, 769,780, 789, 792, 798, 806, 809, 811, 821, 822, 823: n = A,T,C or G
antactnncctannanncnccttnnttgttncttttggccgcancggcctaggctgcganagnacgacagnangggtttttttaaaaggtgacccagnaaacagnagatagagagggctggaactgtcaggaaagacctaacatttccaaggggactttttgggttttttttgatcggggtctcactccattgcccaggctggagtgcagcagcacagtctcagcttgctgcagcctcaacttaccgggctcaagtgatcctcccacctcatactcctgagtagctgagactacggccatgcaccagcatgcccggttaatttttgtattttttgtggagacagggtttcatcatgttgcccaggctggtctcgaacccttgggttcaagtgatccttccacctcgtcctcccaaagtgctgggattacaagcatgaaccactgcacctggcccagggggtttttttaaaaaggtgacccagaaacagaggatagagagggctggaactgtcaggaaagacctaacatttccaaggggactttttgggttttttttgatcggggtctcactccattgcccaggctggagtgcagcagcacagtctcagcttgctgcagcctcacttaccgggctcaagtgatcctcccacctcatactcctgagtagctganactacggccatgcnccagcctgganacacgggaagaccctgccctaaaaaaatntaaaaatanccngcttgggggcggccctgnntcccacctctcngagggtgaggnggaggcacnttnggcccnaagggggnggngngggacccaannnccccc

SEQ ID NO: 22715 - DNA, 857 bp, Homo sapiens
  misc_feature 12, 17, 29, 31, 37, 48, 50, 57, 67, 70, 78, 731, 773, 775,780, 781, 783, 794, 812, 815: n = A,T,C or G
cttaactggggngtacnaatacccccttntnttgttncttttggccgnancggcctncggctgcganagnacgacagnaggggtttcaacatcttttccttcccagcattttagcagagctgccaaacaggtgattaattaaatacatatgtgcatgcttgtacctcgtgtagaaggtctaatgagtaaatttatttgatatgacatagactgaacagtagaaggaaggattaatgacagtcagatcaacaaacaaaagtacaaatggtatctgggctatgaaaagataaagcaatatttgcccaaacaagaagatctagatatccctaaattacctcctatattattaggaagtaaagaccaaatctacaactttgatctggaaattgtatagtagctgatatgaacagggatcataggagagtgtggtctcatagctactctttgctactaccaaaacctgagtggtagcacatcagtgattgcccaaccaaactgcacaattcccattagaaaaagctgtctcaaacccacatcttagaaaggaagtgaatccaccagtgaatcaatacactgggatgtaactttctgcataccccaagaatacctcctgttgcatagcactttttagttttcaaagcttttcagatgtaacagatgtgacagctggtgtttttagtgtgccacagctcatctcacttaattcttaagggaagtgaaaagatgagtgnaattagtatcaataaaaaaaaaaattggaaggtcaggactananacccnntntttggggttanaagtccaagtaaaacagnaanctagtttgtttggaacttcttgcccaggacctttccatccct

SEQ ID NO: 22716 - DNA, 790 bp, Homo sapiens
  misc_feature 3, 7, 9, 14, 31, 52, 62, 65, 72, 87, 655, 719, 727, 763,768, 774, 786, 789: n = A,T,C or G
atntttngnctacnaacccccttgtttgttncttttggccgcagccggcctncggctgcganagncgacagnaggggtgaatctggntaaggatagaacttactcaaccagtggcacaagtggtgatgagaattaagaaggaaaacaaatataaagtgctggcatgcgacaagctctcaatgacatttgtgggagagaagtcaaagctagaatgactttctcttttgaagtatagctaatcaatatagttattccaatgtggaatcattttcttatgagagcgtgtgcgaagttcaccaaggctcagttgcttatacctgaggaatgccttattaaccctagacttactaatacgctaacattatatcagtgatgatgagatatcattagagaaggcacattccaaggtcatcatacatcaatcgtcctaaaaggtccttgataaagaaataactaaatccctagtgacatatcttgcaaacacagtagttggaaactgtttcctaagtttcttatcttcaatgatattttaaaattaagaagtcaaagacttaagtactgtttgtgggagttctggaattagaagcccagacaggaacagtgtattgtggcactgacagcctggcctttcttatttattttacattattagcgngttctctcagcctacttgcataatacccattatatgtatttaatgaatcactcttaacagctgnagaaaagngcttactaatagggggcatcagtcagataagcagtntaacncgtgcncccccctgtggnggng

SEQ ID NO: 22717 - DNA, 765 bp, Homo sapiens
  misc_feature 9, 30, 31, 537, 620, 673, 731, 742, 743, 754, 756: n = A,T,C or G
ggggggagnaagccacttcccctctctggnntctctgtttcactacctatgaggagattaaactagactgtctataagagtccttctctgagttgttctctgatcttagattctaaaggctggcacttgtatgaaaccagctgtcctgctttctggaaaaagtccagcgccattgttaagcaggaaaatttctcctgtgtggttctgccaaaacaaaagctcagactattattcagatctggctgggcaagagagatttgtcagctacatgtttattgaatgatgaaacagctgaacacattcctgcacagaaaacacacattgtctaggtgacaaagagtaatgtggacacatcagggccaccttctgacctttgctagtttttttgttagtttgttttgtttttgtttctttgtattttttgtttgtttttgtgtctgtttttgagacagggtctcattctgtcctccaggctggagtgcagcagtatgatcacggctcactgtagccttgacctcccagcctcaagcgatcctnccacctcagactcccaagtagctgggactacagtcatgcaccaccatgcccagctaattttttttaaattttttgcaagacanggtctccttatgttgccaggctagtcttgaactcctggctcaacgatcctccncttggctcccaagttctgggatataggcatgaacactgggccagctaaaatttatttntcatttacttnnggggaactgtnanaaaacaccc

SEQ ID NO: 22718 - DNA, 807 bp, Homo sapiens
  misc_feature 2, 12, 36, 49, 50, 57, 67, 70, 78, 259, 260, 268, 319, 395,510, 634, 675, 686, 760, 767, 789, 796: n = A,T,C or G
anttaccttggncgtaacaaacccccttgtttgttncttttggcacgcnncggcctncggctgcganagnacgacagnagggggaaactcaagtgatgtttttgagaatatatctgtgctttcactctaaaatttgggtcttttgccttacaaaaatgtaatcaatcattgtattgcacagttacatttttttaaacattatttattatgataagttatcaagatttgtgagttaatttgaagtgttcatccccaattnnatcctacntcatactatcaaattcaaacttttttaccttattagttatgccagttacanagattttgagaaaatattggtgttgtgtcacagttggctgtctttggaaaaatcaaacactgctatgatgaaagtnagtatgaggttcgtgtgatgaggaggtcatgttcccaaatcagcacttactttaaaaggcgctgttgtctcagaccaaaagcttcttacattgataagcaacttcagcaaattcncaggacacaaaatcggtgtgcaaaagtgctagcattcttgtacaccaacaacaggcaagcagagagccaaataatgaatgaactccatgcacaattgctacaaaaagaataatacctaggactntagctatatagcattaaatggataaatccagagactctggnacttcagagtnggaggcgaaaagaacttgctctggtggaaaaactttaaggccttttattttctcgctcatgacaaagcatttanaaacttnttctatttatctttaagaaatncttgcanaacgggtagct

SEQ ID NO: 22719 - DNA, 839 bp, Homo sapiens
  misc_feature 3, 8, 11, 13, 14, 23, 24, 30, 43, 59, 62, 70, 701, 705, 729,730, 795, 807, 831: n = A,T,C or G
atntttgnccnannaaccccttnnttgttncttttggccgcancggcctcggctgcganagnacgacagnaggggttttcattcttctgcatatggatatccttttttttcaataccatttcccaccagtgtatgttcttggcacctttgtcaaaaatgagttcactgtaggtacatttgtacatttgttactgggttctctattctgttccattgatctatgggtctatttttatgccagtaccatactcttttggttgctataattctgtggtataatatgaagtcagaaaatataattcctccagttttatttatttatttatttttgcttaggatagtattatttcttatagtgaaagcattctatgttatttattattagtctaattttgtagttttacaatgctatcctcttttacaaagctatgatcaactcagtgtgtccagatcaggatcatttgtagctatttgcaaaagtagcaatattctggctgggcatggtggctcatgcttatattcccagcactttgggaggccaagacaggcagatcacctgaggtcagaggttcaagaccagcctggtcaacatggtgaaaccctgtctccaataaaaatacaaaaattagccggggatgatggcagatgcctgtaatcccagctactcaggaggctgaggcaggaaactcacttgacccganaggnggagggtgcagtgagcccaaaagnngcattgctttcagcctgggaaccagcgcgactctgtctcaaaaaaaaaaaaaaaaaaaaaaaagngccctttcccgnaaccaacggaaaaacctgggagtncccccccc

SEQ ID NO: 22720 - DNA, 760 bp, Homo sapiens
  misc_feature 2, 9, 647, 655, 662, 668, 684, 686, 739, 740, 752: n = A,T,C or G
gnagacagnagggctgagccacgagtgattgacagagagggtgtgtatgaaatcagcctgtcacccacaggtgtatctagggtctgtttgtatcctggctttgttgacgtgaaagaagctgactggatattggaacagctttgtcaagatgttccctggaaacagaggaccggcatcagagaggatataacttatcagcaaccaagacttacagcatggtatggagaacttccttacacttattcaagaatcactatggaaccaaatcctcactggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaagagaatggagactacacatatgtggaaagagtgaagatacccttggatcatggtaccttggtaatcatggaaggagcgacacaagctgactggcagcatcgagtgcccaaagaataccactctagagaccgagagtgacctgacctttcggacagtctatncagacctngagggcncctggngacgtcagagctttananaaagcttcctgaacggagcaaccctccctgaaacccttagaggctgggctgcnnactcagaggggntgtggaag

SEQ ID NO: 22721 - DNA, 667 bp, Homo sapiens
  misc_feature 553, 558, 576, 593, 607, 618, 651, 653, 666: n = A,T,C or G
aagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaaattagtgcactgaaaggctccaaaggaaaagactgtgaaatccctgtgcctgtgggtatttcagtaactgatgaaaatggtaaaattataggagaactcaataaagaaaatgacagaattttggtagctcaaggaggtcttggtggtaaattacttacaaatttcttaccattgaaaggccagaaacgaataattcaccttgatctaaaacttatagctgatgtaggcctagtaggattcccaaatgctggaaaatcctctttcctaagttgtgtttctcatgcaaaacctgcaattgcagattacgcatttacaacattaaagcctgaacttggaaagataatgtacagtgatttcaacagatatcagtagctgatcttncgggnttaatagaaggagccatntgaccaaggatgggccncaattcctcagctntagaagactanacactctttttgtgtgaatttctgattcacttntntccctcatcagana

SEQ ID NO: 22722 - DNA, 838 bp, Homo sapiens
  misc_feature 5, 6, 7, 8, 9, 10, 11, 33, 39, 52, 66, 67, 68, 70, 71, 78,80, 87, 508, 723, 747, 750, 771, 790, 813, 835: n = A,T,C or G
ttttnnnnnnntacgggctacaatcccccttgnttgttncttttggccgcancggcctcggcgcgnnnanncgacagnangggcagnaattcttagtgtgaaggtgatgtaccacttcagatcagttttcactggagagacttgtaattggtagctgtagctcgtatccatccctagtcactttgccaggatgaatgctgttgggcagcagtagcctaagttacggaaggggagcagattgaatggggttttgagagaaatcttctctgataccttagctttccttctgctctggtcgctatccactcagtcgtgtgctagaaatgtttaacaaccaggatctctggggtgggggtgggggggagcgctgaatttgtagcatttgctgcaaatataaattataaataaaattctaatataaattagaattttatatcaaattctttgatataaattagttactcctcctgtggctgatttcaagctaccacctttagagttcagaaangatgtgcacagttggctcagagccagtgctggcaaaccattgcatttactccacccaagagtggattttcacataatttctaaaataattttttcttatttatatactgacttttcaaaatacaaaattaaaatatcacgtctgacttcagtgatctttttctttttcttttttaaaatgagatctttcagtaatccttaatttaattttttaanaaggagtcttggggggtaccccanggnggactcaactcccggctcagngatcctcctgcctcaactnctgctagctggcttcaggctgcncccccacctggcttatatcctnttt

SEQ ID NO: 22723 - DNA, 735 bp, Homo sapiens
  misc_feature 178, 179, 383, 447, 475, 489, 538, 576, 578, 582, 611, 640,650, 685, 707, 734: n = A,T,C or G
ggggcagatatttaagtgataattacaatataatgtgataactacattcctagtaatactatgatattttgtgagcacggataatgtgttgctttaaaaagataatcagcttcataaactagattctaaattaacaagcacagtgctaacactcccctgactgaacagttatacaaannaggctaagggtcttagaatttattgtctttcttgctgaaagatgattctaataacaataaggttttccccctcctataattttgtgtttccaaaaacaaatggtgaggaaacaatagagtatgtttaccctttctggactcagggacagggtctctaatttggtctctgatttggacagctgctatttgccttagaccttttangttgtgtttctaaagactgaggctaaattgaacatgacagagaggattcaggtgaacagattanctcatctgtcttccatcagcacacctgntgcccccaacaganggcagaaccatttctctttcaagcatgggctactgataaattcagctangcgagctagttcagccttctcattaagggaagttaaananaagnggtgaaatcttaaaattaggagtactggnatttcgttaaggagatgcattacttcttnagccctaggntgagttgaagcaatgcttttaaacagggtttctantggagctttaaaaaaaacttanaagatcctaaactatgggaaaatttcna

SEQ ID NO: 22724 - DNA, 758 bp, Homo sapiens
  misc_feature 1, 9, 11, 16, 30, 88, 170, 184, 185, 187, 189, 201, 238,246, 298, 307, 344, 346, 398, 417, 436, 475, 498, 502, 503,509, 510, 519, 528, 530, 540, 549, 571, 606, 611, 615, 618,633, 648, 651, 663, 668, 674, 677, 686, 689, 707, 719: n = A,T,C or G
  misc_feature 722, 723, 729, 737: n = A,T,C or G
ntagacagnangggtntgacttctcagctntactgaggtgaagcccctgttattgcattattttattcatcaaggagatgtgtaatanaaaagtgttctaaagcaagcaaaatgagtgcccactttagtaaacataggaaaaatttcccttataaggtatgactctttanttccacctggaatnnangnagattaaagcanaagtatatttagaatttattctcttgacagaggaatntttatttnaaacagaccttttaatttatttatgatgtgttgataactactgcactcaganaacacctanatcaggggattagaggattattctgactgcctgacanancatgacctacaatcagatttaattatcctccttttcaccaagaaaatgaaantgggactatccctgctatnttctgttcctatttctatncaaacctttctttcaaggctgcctttagtggacatgtgncacctactgggtgctggctgtgncctnncttccnnatataacantgaacaaanangaatggctgntggcattgnggcatttctagtctagtataancacaggcatttactcatttcaagaattaattaggngattntagntgnccaagggctggagangagcttggggttggnaanacataggggctnttaancttaanagnccagaacanggnccttttggcagaggaaangaagcatgcctnaannatttgncccatctnaaccttttggaagggcctgat

SEQ ID NO: 22725 - DNA, 801 bp, Homo sapiens
  misc_feature 2, 3, 10, 13, 30, 32, 34, 46, 47, 56, 656, 668, 771, 799: n = A,T,C or G
anntcttggncgnaaaaccccccttttttngntncttttggacccnngtagacagnaggggttgtcctttgctatacttggttttgatgccctaaggttgatgcgtccatttgctgcagagcgattgaattacatctttatccataggcagagcaggaggccatacactgaaaaacgccgactgatgcacttaaggtatttgtggcaatctcatcggctgttgtggagcctgcacagatttcctgtgacatagaaaactcttcttgtttagatgcgctgtgctcagtttcattttctaaaaggttatgtatctgcagtcaggtgatagattagcaaggaggcaagtgggagaagaatagcccttttcatgtcttaaggcacatttgaaagtaagtggatctgagagacagtctaattctgggagactaagtttgtttgaatttttttttatggtccttatttgtctgcacaaaagttgtgcttaatcttcatcatactacacaccagaattagaatatggatcagaaaagaattcagattccaatgagccttaatctggatgtaaaagcaggctgagttttccaattgtacatgcaaaaaagaagcaactatgaaattatatgccactacttaatctcttgaatctctcagtttgnattatctagtangttcctaaacgtggctggattaaaagaaattccagtcagcacattttaactgaatgtagccatcagacaatgagcccttcagtaagaagttcagttaagctgnggattgatattaaaaatcatagcctggncg

SEQ ID NO: 22726 - DNA, 800 bp, Homo sapiens
  misc_feature 495, 623, 666, 723, 725, 734, 735, 746, 757, 760, 766, 771,773, 796: n = A,T,C or G
ggggatcttaatagctgcacagtgtctgactctgttaaaggtgctcagaatgaatcttagaatattaatgcccatattttatgccatagcctctagagaggtgaaagagaagtccaaagatgggcagggttgctgagccaacatttctaaggagccctttttgtccgattcacctgccatctgcagccagcctccatataaacaccttttgtgatcaaccctgatggattatttgttagtttatttgttgggggaggggaataaagagaggaaaatgtgggagtacatgcgaatttagggtgaagcaaaagatttttagctacacagatcaataccacctttttctagctttttgataagaatgccaaatagaactgagtcaaaaatatcattgatcaatggattgtatctattgcttttcccttttctgtatgggtttccactccaccagagatgaaaattaaattgacttgtcactattttctcctcatatangcattcatcttgctcaaggctttatttcttcaaattattccaatggcttacttaacagatgtagtttctttcttagttaatcaaaaggatttattgagcaagtactgctaatactaccactgctctgntgggactggtaatactactggctctactactgcatgactggcncataagggttaagctgccttcaggggcatcacctatttaattggccacaacccttantntgtccattnntgaggaacagnctcaaagtttntanttctcncctcnanggcaggctgactcactgaagggntggt

SEQ ID NO: 22727 - DNA, 816 bp, Homo sapiens
  misc_feature 2, 9, 21, 27, 33, 47, 51, 59, 619, 624, 690, 780, 789, 802,810: n = A,T,C or G
anatcttgncctacaataccnccttgnttgttncttttggaccgcangggnagcctggnaaattgggccgagcagagtggctcacgcctgtaatcccagcacttcgggaggccggggcgggcagatcacctgaggtcaggagtttgagaccagcctgaccagcgtggagaaaccctgtctctactaaaaccaaaaccaaaaaattagccatgccttagtggcacacacctgaagtcccagctacttgggaggctgaggtaggcgaatcgcctgggctggggaagttgaggctgcagtgagccatgatggtgccactgtgtactccagcctgggcagtgggactgagaccctgtctcaaaaaaataaaataaaaaaatcaaagttttttgttttaaagttgaactattataagcctaaatttccccacccatagttactttggaacctgtacaaatcataattgagcttgagcctctgcttggtgatatgacacttttggtagccaattctcatgaaatagaagtggcaggcacatagaaaatggggaaggcgccaggcgcagtggctcaagcctgtaatcccagcatgttgggaggctgaggcaggcggatcacttgangtcangaggtctggcctgaccaacatggcgaaaccctgtctctactaaaatacaaaaattaaccacgtggnggtatgtgcctgtgatcccagctccttggcaggctgaggcaggacaatcacttgaccccggagacgaggttgcagtgagccaaatcgacnctggctctncctggtgataganaggattcntctcac

SEQ ID NO: 22728 - DNA, 759 bp, Homo sapiens
  misc_feature 6, 31, 535, 602, 608, 665, 689, 722, 743, 750: n = A,T,C or G
gacagnaggggctctccgctggctgccatgnataaactaattccacatcaatgatgatcaggtattcgtggagtgatgtgtggattttaaagattccctttgtgttgactaccctagtggtggaaacgtcagagaagtcatggaatcattttataagaagtggaactttctgcttaaacacctagagttggtgtctccttccactgcctgtacatacggtgaagcggtgaaccttttaaccaaactgtggagctgatgaagaagcatgacacaatatttgaagggttaactaaactttcctctgacattctaagtgctattttacacactttgttcactgaaagaggatgatatatatccacatgttggggatattaatacattgaaataaggagttagttgatatttgtccctgagaagcaatgagatatacttttgtttggtttctagttgaatatttccttgaacttcgttgaagatttccagacttccaaatgtatttattcacattacgtgtgagccagctagtttgaanggaatgatactggatagcaaaagaatctttcacatttcagctgcattccagataaacagacaacagnttctanggctatgcttctattcatttaattagttcatcaccgccttcattctgtagtttcagnggagtattctataattatgggaanagctgtttagtcaagctgatgagctctactggnttgggtgacaggattattacncctatgngagactcaa

SEQ ID NO: 22729 - DNA, 359 bp, Homo sapiens
  misc_feature 7, 8, 9, 10, 12, 24, 28, 31, 43, 56, 62, 202, 218, 228, 232,234, 248, 251, 257, 261, 279, 291, 296, 299, 300, 305, 309,329, 331, 334: n = A,T,C or G
ttttaannnnantacttgggttanaaanccnctttttttgttncttttggccgcangacagnaagggaggggagcgcgctgcgcgtcgcagagtaacctacttggtctcctgctttcgcgacatggccttcaattttggggctccctcgggcacctccggtaccgctgcagccaccgcggcccccgcgggtggggtttggangatttgggacaacatntaaaactggngggngngggttcaatttttntgncccaantaanaaaggccttattggattntttttgaaaaanttatngtnnctccnaaanaatcaaacttctttttcatnanaanattgataagacttgtttctactcgc

SEQ ID NO: 22730 - DNA, 766 bp, Homo sapiens
  misc_feature 1, 8, 10, 498, 537, 594, 597, 604, 617, 663, 672, 679, 685,700, 715, 720, 732, 745: n = A,T,C or G
ncgacagnangggtgtctttataatagaatgatttatattcttttgggtgtatacctagtagtaggattgctgggtcaaatggtatttctgtctttaggtctttgaggaattgccacactctcttccacaatggctgaagtaatttacactcccacgaagagtgtaaattaaaaagcattcctttttctccacaaccttctcagcatctgttattttttgactttgtaataatagccattctgactggtgttagatggtatctcattgtggtttttgatttgcatttctctaatgagcagtgatgttgagcttcttttcacatgactgttggtcacatgtatgccttcttttgaaaagtgtctttttctaacttttcatctgctccttaagacctgcttttggagaaaagtgtatcagtgccagagagtgtggtaaggggtgttttccttacatgatattggtacatgtctacatgatcttggtacatgtagtaaacnagatgttcatgcctaattgaattctaagatgggcatggnggctcacgtctgtatcccagtgctttgggagactgaggcacgtggatcacctgaggncangagttcnagaccacctggcnacatggcgaaacccctctctactaaaatacaaaaataactggcatnggggctgcnccgtatnccactncttggaggctgagcnaaaaatgcttgaccngagcngaggttcatgancaaacatccctgnctcacctgagaaaaagaactc

SEQ ID NO: 22731 - DNA, 650 bp, Homo sapiens
  misc_feature 43, 44, 54, 57, 58, 60, 61, 68, 73, 76, 80, 92, 93, 95, 97,98, 102, 104, 108, 113, 114, 118, 120, 125, 126, 132, 139,140, 141, 146, 147, 154, 155, 156, 164, 167, 170, 174, 175,181, 182, 183, 185, 189, 193, 194, 196, 198, 199, 202: n = A,T,C or G
  misc_feature 205, 207, 210, 211, 213, 214, 220, 222, 225, 228, 230, 231,232, 237, 238, 240, 242, 244, 246, 247, 248, 250, 253, 255,257, 258, 260, 261, 264, 268, 273, 275, 277, 282, 288, 316,328, 339, 351, 357, 367, 374, 386, 388, 390, 416, 422: n = A,T,C or G
  misc_feature 434, 443, 445, 461, 466, 469, 477, 488, 498, 546, 548, 563,584, 637, 643: n = A,T,C or G
tttttattatggttagctgtcacatataacttttttttttttnnaaagggggtntcnntnngccctcnacccnggncaanaaaccaaaaccnngncnnaaancntaangggannaccntntcaanngaaccngggaaannnaaccnnccatttnnnggaacccnggnctngccnnagcctnnncngttnttanncntnnccnggnanttnntnnaacccntnatnaanannnccaannancntntnnngnggncncnnanngtncggnccctntnanaaggncttccnaggtttaatgggttcttcgaacctttanggagaaggaccnattggggtctntttataaggganaaaaangaagtttttnttatcanggggactaaagncncncggcttggggccctgggccaaaattnaaaatnaaattggagggngaaaaacgntnctaaggacctgttatntgctnccngggacatncgcctttattncccagctganaaacccttgtttcttttgttacccctacacaaggcttggacttggaananaaaaccctgccctantggggcacctgcaaaaaaccngttaaccgccttcggactatggtgcttttccaatcaggaaaaggggggcattngcctancccctga

SEQ ID NO: 22732 - DNA, 857 bp, Homo sapiens
  misc_feature 2, 11, 13, 14, 26, 27, 36, 49, 51, 52, 68, 69, 70, 77, 82,85, 126, 588, 653, 691, 727, 733, 745, 765, 778, 823, 826,827, 828, 833, 834: n = A,T,C or G
anatacctgcncnnacgatcaacccnngccttgttncttttggaccgcncnncggcctacggctgcgnnnaagtacnacagnaangggactgtaacgttttggtgtttgtatgttttgagacagancaatagattgcctccatatcttttaaacattcaggtctcttgtataagaaaaataaccattgtggggtttttgtgcatcttatactaatatgaaacaaacaaaaccccctggatattttatccttagaaagatagaggaagacaggagaagggaatggtcattgtaaattagatagatatattgagtgttagaagattatttaaataattgttcttttgttatttgtactctttgcaaatttatttaaatgcatattcatgtatatcataagtatatattcacatgcatgtctaaatttagtggcatagatctatctcaggggtattaatctttcattcgtgtactgatttgtgttttattttcatttaaaaaattgtggaaccagtggctgggcatggtggctcatgcctgtaatcccagcactttgggaggctgaggcgggtggatcacctgagggtcangagttcgagaccagcctggccaacatggtgaacccccccgtctctactaaaactacaaaaattanctcgcatggtggtagatgcctgtaatcccagctactcnggaggctgagacaggagaattgcttgaccctggagnggaggntgcagtgagccnagatgcaccattgcactccncctaggcacagancaaactctgtttaaaaaaaaaaaaaaaaaaaccctgggccctttntcnnnatccnnctaaaaacttgtagtaccccccc

SEQ ID NO: 22733 - DNA, 701 bp, Homo sapiens
  misc_feature 2, 4, 10, 16, 27, 28, 34, 46, 47, 63, 66, 74, 76, 79, 500,505, 508, 514, 551, 583, 635, 641, 642, 643, 647, 648, 650,651, 652, 653, 658, 659, 664, 673, 674, 675, 677: n = A,T,C or G
anantcttgncctacnaaccccccttnnttgttncttttggccgcnncggcctaggctgcganaanacgacagnanggnatttcttttcaattcagtaagacaagtaaggagaaaaacacttttcaagtcttttatattacactgtatatttatcactgactttactcttgatttcttcctgtatattcaagttattgtctggtgacctttccttgctccagtatatataataacttcattgcttccttgctcctttatgctgttattgtcatatatattatatatgtttatgctgtgagcccatcagctaagtcagcttagcaaggtctcaagatacaaagtcaatgaataaatcaggctgggtgtggtggctcacgcctgcagtcccagcactttgggaggccgggataggtggatcacttggggccaggagtttgagagcagcctggcccacatggcaggactccatctttacaaaaatacaaaaaaaaaaaagttnagtgnggnggtgcncctgtggtcccacctgcttgggaggctgaggcatganaattgcttgaacccgggagggaaaggctgcantgactggaaatcacaccactgcactccaaactgggcaacagggcaagactcngtcttnnnaaannannnnggaannggaancccggattnnncnttttttttttaaaacctgcccaaa

SEQ ID NO: 22734 - DNA, 728 bp, Homo sapiens
  misc_feature 5, 6, 7, 8, 13, 15, 27, 29, 37, 39, 45, 58, 74, 76, 77, 84,86, 122, 723: n = A,T,C or G
ttttnnnntttanantcttggcctacnancccccttntnttgttncttttggccgcancggcctaggctgcgananncgacagnanggtatctaagttaatcacacacctcagtccatgggnacttaatgattgccaactattctattacttttcccctttgtttatctaaccctaatcccattcctgatcttctgtaagtattcactctaaggtatttgagatactttaaatcattgctaaaaatatatataggatagttgtgtaagtagcagtagaaggtagtggtacaaagcacatattctagagctctagactctggatatgatcctggctcaccacttactagccaggctactggccagtacttactgtagctgctgatcctggacaggctacttagactctgtgtttttcatttctttacttgtgaccctggcatggtatgcaggaaagtactctaaagttgagatttgtgcacatgaaacttagggatttgtgctctcaggatcagaatctgcagaagggaagaaagtaagattgggaagagggtgaatttgaattggtgcagttaaaaaaaaaaagctacacagcgtggcccatatgagttctcaagatgggatggcctttatgagttgtcatcaattggaaaagcagggctgagcttttataccccaccattaatcaccatagatgtgagcagttcccaaagggagcataccgngagcc

SEQ ID NO: 22735 - DNA, 634 bp, Homo sapiens
  misc_feature 8, 25, 27, 581, 593, 614, 629, 632: n = A,T,C or G
ctccttgnagaaagtgaagcccagnanaaggcaagtaagtgccctgctcaaatttaattcacttgtgttgtctaacctcagtcactgtcctatcaccctgttttattttcttcggagccttgcttggaaaaacagtggtctactggtttgcttgcttgcccattgtctgtctcacagacagcacgagacatcgcctcatagatggcaagctccttgagtgcagggccttcatctttcttgttcacattcccaaagcttaactgatgctttagagaagctcagtgaatatttgtggaaagaatgagccactggcccactgaatggagactcctcgagggtgcactctgtgattattcatttctgttacccccacacttcctagcacagggcctggcacagatacagtgctcagtaaactgtttgttgagtgaataaatgaatgaatgaatgaatggaaaaaaattccagaggactcagttgctggtgctcttccttccagactctgggaactagtggaaagtcttcagccacaggagatgtgggagaatattctttctggatctctgttttgggttctctgngtgatttggggngtgcgcagagtgggtacacanggcggaaagcatganaanac

SEQ ID NO: 22736 - DNA, 703 bp, Homo sapiens
  misc_feature 2, 3, 9, 13, 15, 27, 33, 45, 47, 67, 570, 630, 656, 669: n = A,T,C or G
anntcttgncctncnatacccccttgnttgttncttttggaccgnanggggatacttgtttcccagnaatggaatggtcataataaatttgtacatgggtaattcacccagattctttgaggtttagtttccagttaatttctggtggcgcttattgcctccttgtctgtgtttttaggggacagcttacaaacaccaggaagtacagctacccctaaagtccctctgcaccaaaatgtgaaaaacaacctggctgtttagagtagaatatataattcatttaagaacaattttgttgaattatggcccagcaccatggctcagtcctgtaatcccagtgctgcagtgagctatgatagcgccactgcactgcagcctgggcaacagagtgagactgtctcttaaaaaatttttttttggctgggtgcagtgcctcatgcctgtaatcccagcactttgagaggccaaggcgagcagatcacgaggtcaggagattgagaccatcctggccaacatggtgaaaccctgtctctactaaaataaaaaaaattagccaggcgtggtggcggncgcctgtagtcccagctactcaggtggctgaggcaggggaattgtttgaacccgggaggnggaggttgctttgagccaagatcacnccactgctttcancctgggcgacaggcgagacttcgtctcaaaaaac

SEQ ID NO: 22737 - DNA, 263 bp, Homo sapiens
  misc_feature 46, 52, 102, 123, 141, 142, 153, 154, 161, 169, 179, 184,201, 209, 212, 219, 228, 235, 238, 252, 259: n = A,T,C or G
gtgggttttgggggaaccaccttttaacctgggaaaggcccagaanaaaaanaaatggttcccctttttgggaaaaaccttccaagaaaaaaaaccgaaaancccctttgggctttaccaagnaaaaaaattccaaggttnnttttttaaaannaaattanttcccccntttggggganaaaangggaaaaaaaaaaaaancccctttnttnccctttntttttcccnggggaanganggtttaaaccccanccctttnggaa

SEQ ID NO: 22738 - DNA, 767 bp, Homo sapiens
  misc_feature 9, 10, 18, 19, 20, 32, 44, 46, 47, 55, 61, 546, 569, 646,673, 676, 690, 721, 743, 753, 758: n = A,T,C or G
ttttcaccnnacgataannncttgtcttgttncttttggcacgnannacgacagnaagggnagtaccattgtggttgaaatgctctgatggaagactcccattataccagcatcagcagtgtggaggggccagccagtaaagtgatctctctctggttggaatatgtagagaaaaggagacaacaccgtcgcccagaagtggaggttgccatattacttgcacaaacctcatgccgttaggtcttcagccacagccgatatttgcagagatgtatctccagcgatctatctccagagatggaacctggagaaatgaccaaacttgacacagccttcaatggttggataaatagctcattaacccaattagtagagaaagctgtgcaatccaagcactagcactgtttgtaggagttattaatggagaacacaatgtattattaaggggcaggggtttttgtttttctttttttggttttaagtcaagagattgtcggccaggcacagtggctcatgcctataatcccagcactttgggaggctaangcaagaggatcacttgagctcangagttagagaccagcctgggcaacgtagcgagaccctgtctctacaaaaaaaattcaatgaattagccaggcatggnggcatgcacctgtggtcacagctactncanagcaaagttggacnattgctgaggcaagaggtgaggctgcatganccctgttctgcactgacttcanctgggcacanacaanacctgtctc

SEQ ID NO: 22739 - DNA, 444 bp, Homo sapiens
  misc_feature 324, 336, 443: n = A,T,C or G
ggggattttttgttgttatggtttacgtgatgaaaaggagaaaaaacagaatcatacctgggtggagagagggagacaaatagccataaacttcatcctggagaacaagttaccatgcaaggagttgacatcagttgttaagtgaggcccattcttgtttttacatcggtcctttgtggtttttctgggccagcagagattctgcaccccaactcccaggagaaaatgtaatacctgagcaagcacagccttgggtgtgcttggacaagagacccagcggcagagcaccttttacattttggaccgttcatgaatgggcaatgntgtgttgatacncagccgagttctacgttatgtgctgtgactgtgcagctgaccacccccttcccaggaggcagtttccagacaggagagcaatgcactacagacctgctctgacttgnt

SEQ ID NO: 22740 - DNA, 822 bp, Homo sapiens
  misc_feature 2, 9, 15, 27, 33, 47, 48, 51, 58, 83, 233, 410, 574, 593,599, 607, 633, 705, 727, 733, 746, 754, 763, 780, 784, 797,799, 803, 806: n = A,T,C or G
anatcttgncctacnatcccccttgtnttgttncttttggaccgcannggnatctggnccatccttaatttgcaaagcacagnatagatctaaattttccttaattattatttcctctttggtggatttctgaaaagaagtgtgtgtgtgtgtgtatgtgtgtttgtgttcagacatctgcctatctatagctaagcttctgattaaccaagttttaatctatctacctcatngcgctttgctattttctctttctttatcctccaattgctccactaggtggggggtctggagggcaaacacattcattatgttgccagcaaacaagataggaattgcactgcaggggacaaaattaaatttacagctttcccttgtagatgtcataaactattgatttaacacaagangagaaagctgcaatgatgggggcacaactgcagcgtatagctggactgtgtctggggagaggtcagcaatgactgccaacagccaagtccagacatctgagatcaactcctgcccacaggcaaagggtgaaagaagctagaccgtggtatgcttgctataagancaaaatttcaacctaaaancacggnctgctcanaatactatctgtacacctggatgaancattgctgattaatatggagagaacagattagtgaatgttacatcaagttcttggagtctttgacctgtgangggctttaaaagtacaagtgangagtcngctcaaaaagcanatacctgngaaactctntctctaatataaacaanttantcttttcttagancncttntgnacccaaactattaaga

SEQ ID NO: 22741 - DNA, 718 bp, Homo sapiens
  misc_feature 2, 19, 30, 43, 50, 60, 63, 71, 77, 615: n = A,T,C or G
antcttgacctacgaaccncttgcttgttncttttggccgcancggcctncggctgcganagnacgacagnaggggnattcggtaggtctgggatggtgatggggatgggacctcagaatgtatattgctaacatgctcccaggtaatgctgatgcttcaagtcttggaaccacacttcgagaatcactgttataatgtacagcagaactgcatgatcaggtaagtgtgctgagctgttgatcctcctcattcctgagctgggtgtgtagagacaagagcaggagactaggggctgatgatcttttagtcacatccatttaccccagagtgctctatacaaatagcatttttatgtattccccggcatgaaaaagctggaaagcaccaagagaggttggtgttaaacaacatgaagttttggaatctcagaaagtctgaatgagttaatttttttgagctttagcatacttatcattttataatgaggataattccttaaagcaattctgtccaatagaactttgagatgatagaaatgttctgtatctgagctgtccaatggtgtagccactagtcacatgtggcttttcagcatttaaaaaatggctagtaanggtggggcacagtggcttatgcctgtataccagctgtttgggaggccgaggtgggagaactgcttgagtgtaaagtctgaggctgcagtaacttatatatggc

SEQ ID NO: 22742 - DNA, 835 bp, Homo sapiens
  misc_feature 2, 10, 19, 29, 30, 56, 521, 652, 684, 686, 699, 752, 775,780, 789, 806, 819, 833: n = A,T,C or G
anttaactgngcgtacaanacccccttgnnttggtgcttttggaccgaccaggggnagtgcctgacctcaagtgatctgcccccccgacttcccaaaatgctgggactactggcatgagccagtgctcctgtcctcattccattcttcaccgtggtactgaccatccatttattcagcaccaattgtgtgccagaccttgtgtcagcattatggaggacttcccttgggaggcttgttagctgtacttgcaatctgatttgggttcccaaatcagcatataacaccaggtatttctctaatagagtatgtgccacactttctgctaactgcctgtttatcagtgtccccacatcccaatatctggttccttcaagggcagggagcacagggtatggcgtcagagtggtactcagtgatgtttactggtgggtagaaggaagggttagtccctgtttttgaagactttatgttctagcaggcagaaatgaagcacaaatagttcaagaaataaacaatttangaataaagtcatttggtttgcttcgcagaaatgtcttattgctgatttgccagcatgagtggcaaatatataataaaacctggccgggcatggtggctcacgcctgtaatcccagcactttgggaggccangtgggcggatcacgtggcaggaaatcaagacntnctggccacatggngaaatccctctctactaaaatataaaattagccagcctggggggggcgcctgnggcccaactcttggaggctgagnagganaatgctganccaaagcggaggtgcanggcccggatgccnctgcctcacctggnga

SEQ ID NO: 22743 - DNA, 779 bp, Homo sapiens
  misc_feature 9, 28, 87, 568, 649, 707, 733, 755, 757, 759, 766, 773: n = A,T,C or G
gtagacagnagggcaactcagccctgcngctctcattatgtcttccccaaaccaggaggcagttgcaggtcagtgattacccatggnaaagagcatctggccaccaccaaaccttggcgttctactctaccctagaccagtaggtaagcccaagtccacacatgtctatagggcatatcctctggccttgtccaccttgtgtggctgagtaacaaccacaaaaatctcacccagcatgggagcctgtcatacagctgtgcccaactacaggttccaaacaacagagccagggaagacaacttgcaactctacctaatcagacatggctgcagagtccaatcagcagcctcacctgatggcaaagttcagctagtggtttcactgatcacagagcacagccagaaatactatttgatctcagagcacaggaagcagctcagcccaattatagaacctgacaccaagcaaaggctgccagccacccctccagaatctcaggctagactaaatggtaaagatctataaccaccaaaaaacacctgcaaaggctggaaaatttggctttctnctcaaatgcacaggcataaggacacaaagataatgaaaaatcaggcaacatgacaccaccaaagaaaccaataaagcttgngtatagacccagaataatggagatctatgaaatgactgacaagaattaaaatatcctntaaagagttcgggactccagaaatcngatgagattagtgagttaaaangntntacaaanaagttgnagaaag

SEQ ID NO: 22744 - DNA, 656 bp, Homo sapiens
  misc_feature 621: n = A,T,C or G
gggaacatcaattaaaaaaacatattattgaaactgtacattatgatctggaatagaacaagaagatctatgtgcacaaagaaaaagttaattggaaactatgattaatggagaagtctatggggtcacgtggaaactgtttaccttgccacctctctgtagtcattaaaactcttgaaaatgaattttcttatcctaagagtgtaaaactgatgttgtggagcattttgcacatgccagacacagatgaattcaagacgcagtccctacactccgggtttctacagtttagctggacagagatgaacaaaattgcaatggagtgtgtaaggggccatagtgtgcaaggcccaacacctccctgagcgaaggacgtcagcactggttggctggatcctggccaagcttgctgtggggaagtggtcgatgtagtgtggggaaggccatttgcactgatggcccctgtggagcggaacattctcatggctgtgtctgttacccaaataactagaggatgctctgtgtgcaaatcttggtttctttaatcagcataaaatctggaatgaggagaaatagcttctgaaatgcgctttctcaaagaaggatgagcagaatgagccncaccatcttaccaggagtgtccagttttttggctt

SEQ ID NO: 22745 - DNA, 842 bp, Homo sapiens
  misc_feature 12, 19, 20, 22, 23, 29, 31, 73, 80, 85, 90, 103, 258, 633,634, 677, 686, 724, 728, 742, 759, 760, 764, 781, 787, 798,799, 804, 809, 810, 811, 831, 832, 837, 839: n = A,T,C or G
ttttaaaaggantaaacgnngnnaaaaancncctctcttggggcttttggaacgccccggcctaggctgcganagttttnggganggggnaattcatagggancgcctccatgtaggaaacttgggcaggatttctatattacaatattgaggcagaattccttcttcaaaaacatgtttttgcttttaaggccttgagctggtgggatgagagccagccatgttatccagggtactttccctttacttaaagtcagntgattgtcaattgttaatcatctctacaaaaccttcacagtgccacctcgattagtatttgaccaactaactaggcatcattatgtagccaagctgacacataaaaattaagcacccctaggtgaaaaggtactgcctgcagcagaagagggtgtgaggggcacagagccccctcctggtcatgaaacattgaagtcatgcttcacctagtcatgaagcattaaaggttgtggcagccttgttctccatgctttttcagtacatttgatgttgtatggtgggggcaggagcatataagccagtgcaaatggtttttgttgcggtctccatacagaccaagggtctattttttttttttttaaacttgaaaaaaannaaaacattttactttccttaaacctaaaaggggcttgttaaantcaaaaagngcctgaataaaaaaaagttttatttgccccacaaaaangtangaacatgttaactngaggggggctaattaannaaanttttgggggacctttgnaacctntcaagatttannaaatncccgnnncaaaaaccttccttaaaaannaaaancngaa

SEQ ID NO: 22746 - DNA, 734 bp, Homo sapiens
  misc_feature 7, 8, 26, 28, 46, 48, 67, 69, 70, 78, 224, 227, 233, 234,235, 237, 246, 249, 263, 266, 278, 284, 285, 286, 288, 289,295, 298, 300, 305, 307, 310, 311, 315, 322, 327, 328, 329,330, 331, 332, 333, 337, 339, 340, 341, 343, 344, 347: n = A,T,C or G
  misc_feature 348, 353, 363, 365, 368, 375, 376, 377, 384, 390, 391, 396,401, 406, 410, 415, 416, 426, 430, 437, 450, 451, 453, 455,472, 473, 480, 497, 499, 509, 513, 540, 555, 557, 608, 628,634, 637, 649, 650, 653, 659, 660, 697, 701, 708, 710: n = A,T,C or G
  misc_feature 720: n = A,T,C or G
taactgnnggtacgaatacccccttntnttgttgcttttggcacgnanccggcctacggcctgcganannacgacagnaaggggatatcttacaactatttttgggtaaattatatattttccttcctagtagaagtgttactgcccgtaactagctcaaaataccaatgcagtttctgcattctgggttttgtttttcctttttttttttttttttttttttnganattggnnncnccccccccnggngggggggggggggnggntttcatccatcnggcaannntnncccccnggngnaaaangnatnncccncccaaanccccnnnnnnncggngnnnannggnnccccncccccccccnantanattttgnnnttttaanaaaaannggggntttancattngggnccggnngggtttaaancccngcccctngtggacccccccnncnanccccttgggattagagnnttccaantttttggggaacccccngnggacgcccanagantttagggggttgggggccaaaaagcgngccccgggtttaccnanaggcccatacaaaggggctaaaaaaactttttggaaaccccggtttttctncccaagggccttaaaatccngagganggnaccccaaagctnnaangggggnnggccctttccccccttccaccttttttaacccggggnaagngtttttnanggaacaaaanaattctttaaaaat

SEQ ID NO: 22747 - DNA, 717 bp, Homo sapiens
  misc_feature 24, 28, 30, 43, 50, 59, 61, 63, 66, 71, 73, 77, 235, 247,256, 268, 272, 281, 318, 343, 387, 389, 394, 400, 409, 421,423, 425, 429, 436, 443, 482, 494, 511, 525, 533, 546, 561,715: n = A,T,C or G
taactggggtaaaaacccccttcnttgntncttttggccgcancggcctncggctgcgnanantcnacagnangggntattatctgtgtagtagcctgtttaaagtgatcattgctagtgcatggtatagaattacaaacttgtaaatacttctcaagattgccactttaaaaaaaaaagcaaaaagagctctgtagccctatttttttttttatttccaacaggaaatttgttnttgtttcaaaangggggaacncccattattctntgtnggccacatnaatgtcatccatttgtttattgcagcaaaaaaaaagngaaaaatggttgatacaggggcaanctgttccttttaggttactttaaaaagtcatggaatttcggatntncaaanaaagcntaaggaatnctctaaccagtntntntgtntacagtntccagtntaaaaatgaaaatgtaatgtagttattaaaacattatgngggggcttccanaagcctgtcctcctttntaccttccaaaagnaacttctntcttgaatttggngttcgtcattctggngcatgcttttacagttttacaaaatacacacccattcccaaacataaataatactgtttcacaacataaattggattatgggacatgttttaaaacacgatatacattgtatctgtgcaagtcaggttccaagggaatgggactcaaaaattangg

SEQ ID NO: 22748 - DNA, 723 bp, Homo sapiens
  misc_feature 12, 13, 26, 27, 33, 44, 46, 53, 63, 65, 66, 73, 75, 215,236, 257, 261, 264, 267, 269, 273, 293, 319, 372, 390, 395,413, 416, 424, 426, 430, 437, 444, 464, 483, 485, 487, 522,525, 534, 554, 595, 637, 644, 655, 673, 719, 722: n = A,T,C or G
taaacgggggtnnaaaaccccctttnnttgttncttttggccgnancggcctncggctgcgananncgacagnangggtattatctgtgtagtagcctgtttaaagtgatcattgctagtgcatggtatagaattacaaacttgtaaatacttctcaagattgccactttaaaaaaaaaagcaaaaagagctctgtagccctatttttttttttntttccaacaggaaatttgttnttgtttcaaaaggggggaacncccnttnttntntgtnggccacatgaatgtcatccntttgtttattgcagcaaaaaaaaagngaaaaatggttgatacaggggcaagctgttccttttaggttactttaaaaagncatggaatttcggatttncaaanaaagcttaaggaatactntanccagtttntntgtntacagtntccagtntaaaaatgaaaatgtaatgnagttattaaaacattatgngngngcttccacaagcctgtcctcctttctaccttccanaanaaacttctntcttgaattggggggttcgncattctggggcatgcttttacagttttacaaaatacacacnccttcccaaacataaataatactggttccaacataaattgtnttatggnacatgttttanaacacaatttacattgtntctgttgcaagtcagggtcccagggaaatgggactcaaaaaataangcng

SEQ ID NO: 22749 - DNA, 524 bp, Homo sapiens
  misc_feature 9: n = A,T,C or G
gtagacagnagggactccagcttacaagctgacaaaatgacataccgatattttaagccgccaccttgttcctgggtgcttgagaaatttttccagttagtgtaataagagttctgaattatctacagtgtataattatatcactcatagttgctattaccagcttgatgatgaaacttaactttaaaaaatattgaagcttgggctggatgcggtagctcacgcctgtaatcccagcactttgggaggccaaggcgggtggatcacctgaggtcaggagtttgagaccagcctgaccaatatggtgaaaccctgtctgtactaaaaatacaaaaattagccaggtgtggtggtgtgtgcctgtagtcccagctactcaggaggctgagacaggggaattgtttgaacctgggaggcggaggttgcagtgaggctgagacaggggaattgtttgaacctgggaggcggaggttgcagtgagccgagatcaccccagtgcactccagcctgggcaacagcctgtc

SEQ ID NO: 22750 - DNA, 805 bp, Homo sapiens
  misc_feature 2, 12, 15, 19, 25, 27, 33, 46, 55, 67, 71, 76, 78, 84, 90,93, 425, 430, 462, 474, 501, 537, 539, 543, 562, 577, 580,601, 616, 620, 642, 663, 664, 684, 716, 721, 725, 731, 744,760, 762, 764, 767, 770, 781, 788, 790: n = A,T,C or G
anttacttcccnacnatcnaccttntnttgttncttttggaccgcncccggcctncggctgcgatantacnacagnangggggnaatggnagntagaggtttgatcatctatttatctctatacatggcaactaaaactatggagtgattcatcaacactcaggaaaaatgtgatgagagctgggctaaaaagctggccaaggtagatcagctgtgatgtgcagaaaggaaggaaacatcagtcagaattaaaagaaaacaaggagtgcttggtgtcttaaaagccaagagaaagaggccaggtgtggtggctcacacctgtaatcccagcacttaaggaggctgagatgggtggatcacctgaggtcaggagttcgagatcagcctggccaacatggtgaaaccccagatctactaaaaatacnaaagntaacccggcgtggtggtgtgtaccctgtaatnccagcaactcangaagctgaagcaggaaaatcacttgancccggaagcaaaagttgctgggaactgaaatcctgncnctgncctccaacctggggacaanccacacttccactcnacnaaaaaccaaaaaagcttggcnccgggcccacccctntatnccccattttggaagcccaggcngccgataccttaggcagaatnnaaacccccggcccattgggnaaccccctgtctaaaaaaaaaatttctggggnggganaggncccttntccccttttcggnggtaaggacaaaatcntnanccnagngaggtgggggncccaaantnttttccccccccggg

SEQ ID NO: 22751 - DNA, 369 bp, Homo sapiens
  misc_feature 24, 44, 45, 46, 47, 48, 55, 71, 81, 87, 98, 101, 102, 116,125, 141, 142, 148, 151, 155, 161, 163, 164, 168, 175, 271,295, 296, 299, 321, 326, 361, 366: n = A,T,C or G
ttttttttgggggacccccgcccnaggaacgggggccccccttnnnnncgggggncccttggggcccgggnggaatttaantttttncgttaaacccngannaaagaggggggttnaaccggggnctttggcccgggaaannaaaganaancggnaaccangnnaaanggggggnaaatccccctttttcccccaacctttttcccaaccaacccccaaggtttaattttgggggttgggttgggttaaaaaaaggaaaacccccccccanttttcccggaaaaaaccttgggtnnaangggccccccttttggggggaanaaaanaggccccccatttttttttcccaaggccccccggnaaaanggg

SEQ ID NO: 22752 - DNA, 852 bp, Homo sapiens
  misc_feature 2, 10, 11, 15, 16, 34, 36, 51, 59, 69, 80, 106, 118, 697,759, 764, 798, 824, 837, 845: n = A,T,C or G
anatctttgnnctannaaacccccctttttttgntncttttggacacgccnccggcctncggctgcganagtacgacagnaggggtttcaaaacgtagcattaagnaaattgaaaagnacaagtcacttcctggaaaaaaatatttgcgaattatctatcagatacagggcttgtatccagactaaacaaagaactcgtgcaactcaataaaaataacagaaacaccaaatttacaaatggataggttcagaaaagattctagtgagtgtcatctacaggaacagctaccactatgcagttacagggatcagcagacactgatgggagcacctctaggagccacataaagacctgctgttagcaagaggagccaagtggaaagcatcttgtgaggttgctgggagaggcccacaggggtcaatgcatgctgtttgtgaacagcagcaggtggtaaaaacagatggtgttgagtgcataatgtgggtgggagtaccttcctgctcacacaaccccagccaactgtcatcaccatcatgggccatcctccaagaaaaaaggggtgttagccccagttacctatttatgtgtgtgtgtgtgttggggagaggagtgggaacacagggatagttggtattttagcatacatttcactgaatataaagaacaacaacttcctgccttgataccaaaagtggnttcaagcccagaatctctgagtagatactatattaggcatctaaatccaaacaaacaaccanccctnccaacaaacaaaaacagtataatttatgtgaaanagtctaggacctttgagttcaaccanaaacacttcaaantataaatnagtcctg

SEQ ID NO: 22753 - DNA, 597 bp, Homo sapiens
  misc_feature 12, 339, 429, 432, 476, 478, 486, 501, 503, 513, 524, 530,564, 565, 568, 577, 581, 587, 590: n = A,T,C or G
ggggatccttgntttgaaaaccttaagcacttaaatgacaaaacagtcgcgcacacagagatagatgtaaaggtgatattttacttaacattttttttaacacccaaatttgctagtagagaaaaagagaagagggaagactcccaaatggttatgaagtttgggagaggagctttataggggtaacatgaagatgaggaacctaatatgggattagagcataggaaaagagacacagccttagattctattcaaaatagtcagtgtagaggccaggcacagtggcttatgcctgtaatcccagcactttgggaggccaaggcaggtggatcacctgangtcgggagttcaagaccagcctgaccaacatgaagaagccttgtctctactaaaataccaaattagccaggcgtggtggcgcatgcctgnttnccagctctagggaggctgagacaggagaatcgcttgaccccaangnggagttgngggagccggattgcncnttgcctccanctggcacagancaactncgctcaaaaaaaaaaaaaaaaccctgggcgtttnncgnatccactgnaaancttggngtnccccccc

SEQ ID NO: 22754 - DNA, 802 bp, Homo sapiens
  misc_feature 2, 13, 14, 15, 23, 28, 35, 50, 52, 67, 69, 74, 571, 603,607, 625, 642, 645, 659, 682, 691, 694, 760, 767, 772, 773,774, 775, 779, 781, 782, 787, 796: n = A,T,C or G
anatactgggccnnncgataccnccttntccttgntgcttttggaccgcncncggcctacggcgcgngnagtcnacaggaggggatgaagtaatttattgcaaatcctaaagcaagtaagaagtggtgctaattggagccaagatcttctgattcatattcaggtgtccattctcttgtatacatatacttaaaagtgctatttttttgtggtactataaactaatggttttcaaacattttggtctcaggacacatttatactcttaaaaatttctgaggaccccaaaaatcttttgtttatatagactatgtctgtccatacttaacattagaaattaaaactgaaaaatgtttaaaatatttatttatttaaaaaataacaaacattaggccaggcatggtggctcatgcctgtaatcccaacactttgggaggctgaggtcagtggatctcatgaagtcaggagttcgagaccagcttgaccaacatggtaaaaccccgtctctactaaaaatacaaaaattagccaggtgtggtggtgggcgcctgtaatcccagctacttgggangctgaggcacgagaatcgcttgaaccccggangcanaggttgcagtgagccganatcctgccattgcactncancctgggcgacagancgagactgtgtctcaaaaaaaanaaaaaaaanaanaggggtgatataataatatgctttatgaaaagggttcccccccccaaaaaaaaaaaaaaaaacccnggggccnttttnnnnaccnanngaaancctggggtncccccc

SEQ ID NO: 22755 - DNA, 826 bp, Homo sapiens
  misc_feature 2, 15, 32, 46, 53, 63, 73, 102, 397, 481, 495, 711, 745,758, 800, 803, 804, 807, 814, 823: n = A,T,C or G
anatcttgacctacnatcccccttgtttgttncttttggaccgcancggcctncggctgcganagtcgacagnaggggaagtacattatgggaggtcatagnataaacaaccagtcagcctctaagcatcagaaaatccgtgatgtccattggcctgagagatggtctgcatttctttgaaggaaaaaagcaggttttaaaacactagaaccgaatcaaatcctaaatttgaatagaaagattagaaaggcttatgcatgggaaaaagattcagggtatccaacggttaattctgactatttctgagtaatttaaatttacctataatttaaaaaaaaaaataaggtcaggtgtattgactcaaacctgtaatcccagcattttgggaggccgaggngggtgaatcacttgagacgaggagtttgcgaccactatgggcaccatggcaaaacctcatatctactaaaaacacaaaaattanccaattggtggtgngtgcttgtagtcccagctacttgggaggctgacgcatgagaatcgcttgaacctagggggtggaggttgcaataacccaagatctcaccactgcactccagtctgggtgacagagcaagaccttgtttcaaaaaaaatttttttgttttttaattaggaatcaaataagataattaaatgtaaacttacacttaatttactttttaagcattttanaattggattctaattttgggtcgggcattttaanaatcaataaattnttttaaagcaaaaaaaaaaaaaaaaaaaccctggggcgtttnccnnaanccaaatnaaaaacttngac

SEQ ID NO: 22756 - DNA, 544 bp, Homo sapiens
  misc_feature 305, 355, 409, 414, 431, 445, 447, 454, 456, 472, 477, 478,499, 514, 518, 524, 526, 527, 535, 542: n = A,T,C or G
aagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaaattagtgcactgaaaggctccaaaggaaaagactgggaaatccctgtgcctgtgggtatttcagtaactgatgaaaatggtaaaattataggagaactcagtaaagaaaatgacagaattttggtagctcaangaggtcttggtgggaaattacttacaaatttcttaccattgaaaggccanaaaccaaataatttcaccttgatctaaaacttttaactgatgtaggcctaatangattncccaatgcctggaaaancccttttgctaaantngggtttntnatgccaaaacctgcanttgcnnattaccccttttaaaaaattnaaaccctaacttggnaaanaatttncnngggttttnaaaaaantt

SEQ ID NO: 22757 - DNA, 272 bp, Homo sapiens
  misc_feature 5, 6, 7, 8, 12, 19, 25, 26, 28, 30, 41, 49, 52, 53, 57, 60,185, 207, 213, 215, 220, 224, 227, 228, 233, 237, 245, 246,251, 252, 263, 264, 265: n = A,T,C or G
ttttnnnnggantaaacgngcgtannanancccccaatctnggggcgtntanngganggnattcagcattttccccctgagaaagctcttagctagtgggtaaaaaatcagatgtcatttaaattcaacatattttaatattctaaattcaggaacctatgtattttcttttctttttttttttnggggctaaaacaggaaattttnccttantncattnagtnagnnggggntttnttattttnnttttnnaaacaaagttnnnctctcat

SEQ ID NO: 22758 - DNA, 571 bp, Homo sapiens
  misc_feature 2, 10, 11, 19, 23, 28, 72, 73, 81, 94, 492, 527, 534, 535,537, 548, 549, 554, 555, 557, 560, 561, 564, 565, 566, 568,569, 570: n = A,T,C or G
antaacttanncgtacaanaccnccttntcttgttgcttttggacacgcacccggcctacggcctgcgatannacgacagnaaggggggaaggnattcagtggtaagaggcaacgtagtaaagagtatcagctatcaactttgagtcagagacttgggttcaaatgctgactctgccattcattggttacacgtcctcccgctagaaattctgcaaggaatttgctctctcagtgttgcatttcttcacatttacatggagataataattactgtgaatattgaataagtggccttcaataaattatttgtttatttattttcagagacagggtcttgctctgtggcctaggctggagtgaagtggcaccattatagctccctgcagcctcgaattcttggcctcaagttatcctcccacctcggcctcccaagtgtggggattacaggcatgagctactgcaccctgtcacaataaaattgtttaaatagntgcttaattattccttaaattattcctgggggcanggcgcanngnttcacgcctgnntcccnncncannccnnngnnng

SEQ ID NO: 22759 - DNA, 231 bp, Homo sapiens
  misc_feature 158, 171, 185, 190, 194: n = A,T,C or G
ggggctctttcccttcggtttgccactgaagatcctggtgtcgccatgggccgccgcccgcccgttgttaccgtattgtaagaccagccgtacccaagtctcgcttctgccgaggtgtccctgatgccagattcgcatttttgacctgggcggaaaangcaaagtggtgantttcccttgtggcncatgngtcnatgatttaacactgtcctctgaacctgagctgccgat

SEQ ID NO: 22760 - DNA, 827 bp, Homo sapiens
  misc_feature 2, 8, 16, 20, 26, 27, 31, 63, 64, 65, 78, 83, 655, 689, 696,702, 749, 776, 779: n = A,T,C or G
anatcttncctacganaccnccttgnnttgntgcttttggaccgccccggcctacggctgcgnnnagtctccgacagnagggnacatgaaatcatatgaatctgcaagtggataattggagtgctttgaggcctatggtggaaaaggaaatatcttcacgtaaaaactagacagaagcattctgagaaacttcgttgtgatgtgtgcattcatctcacagagttgaacctttcttttgattgagaagttttgaaacactctttttgcagaaaccgcgagtggatatttggagcgctttgaggcctgtggtggaaaagggaatatcttcacataaaaactagacagaagcattctgagaaacttctttgtgatgtgtgcattcatctcacagaattgaacatttcttttgattgagcagtttggaaaccgtctttttgtagaatctgcaagtggatatttggaaccctttgaggcctatgctgaaaaaagaaatatcttcactacatgatgaccaccagcagcacctggggaaaccagcaccctgtggaattccatacggtgcatagaatacatcctcccttcagtcggcttgggtcaacttaagtcatgggccacctggctgatagcagtttccacagaaatgcttcaagatggnataataatccaaatctctttgcatggggcatggngtggctntctganaaaacctggctttataggaaggagaagaaaatgcttcttgagggaanaaccacaggatgtgcctaggaatgtcncanagagaggagctggatgacttttgcaatatttcttgggtcttggtcctg

SEQ ID NO: 22761 - DNA, 850 bp, Homo sapiens
  misc_feature 2, 16, 18, 27, 35, 49, 69, 71, 73, 77, 82, 84, 90, 121, 767,792, 807, 811, 813, 816, 833, 840, 843: n = A,T,C or G
anccttgaccctaacnanaaccccttnttttgttncttttggaccgcanccggccctcacggcctgcgnanantacnacagnangggggnaatatggaggtgctgttgaggagctctaggnaactttactgagtcagaaaaatttttctacagacagtgtgaaagagcctcagtagtttgactgagatttgaattatttagctgttttttggcttcttaataccaagtgaaataagcagaccgctgtgcatccaaaagctttgttcctttttgctctagggctgtttttagatggactaatttagggatataccaggagcccccaccatagccgaagagagtttttggtaaggctttgccagtgagaaagcaagcagacagtattagaactatagcggcaaagcaggagtttgataaggtgaggtttcaattgagaagttcccatgggagaagcaggattaaacagacagaagagagaggcctcataaagagcagggaaaaaattccagcccaggcattggggagtggatccccactggaaacaaagagccaggagaagtcttcatcccaggagacaaagatccaggaagaattttccagccaagagccaggctcaggagtcagggagtaaatgtcttcttgacgcagtgagccccagaaagaaagacttctagctgagtagatgcctttcaaacaaagaagtctgggcctctaatccagcttcagacaatgtaatcagaatcttcttcaaaatctgtcctcactgngattcgatggacatttatctggacnctggatttgggatcnctcncnccngatccccaaaagcagcngactganacnagtcttg

SEQ ID NO: 22762 - DNA, 436 bp, Homo sapiens
  misc_feature 2, 9, 10, 11, 15, 20, 22, 23, 29, 31, 32, 51, 52, 70, 72,375, 410, 418, 419, 420, 421, 422, 423, 424, 427, 428, 429,430, 431, 432, 433, 434, 435: n = A,T,C or G
anttaactnnngcgnacganannaccttngnnttggtgcttttggacacgnncccggcctacggctgcgnanagtactacaggagggggtttctcttgaatataatattacaaatggaattattaagtaaaaggtataagtgtttgtatggcttttactatacattaccaaaaaaatgtctaggctgtttttctgtttgtttgttttttgttttttgagacagcctcgctctgtcaccaggctggagtgcagaggcactatctcggctcactgcaacctctgcctcccaggttcaagagattctcctgcctcaacctcccaagtagctgggattgcgggtgcacaccaccacgcccagctaatttttttttttgngtttttagtaaaaacggggtctcgccgtgttgggnccaggctnnnnnnnaannnnnnnnnt

SEQ ID NO: 22763 - DNA, 650 bp, Homo sapiens
  misc_feature 9, 12, 13, 15, 19, 20, 25, 32, 67, 73, 74, 627, 639, 646: n = A,T,C or G
acttacttnccnncnatannccttntccttgntgcttttggaccgcacccggcctcacggctgcganagtctnnaggaggggtggtctccctaaacacgtgttcaacttcttgaagaaggaaatctcatgtctttggctgtattcagcatttttcagtagcagttacatattctagttttcatggtggatggagtggtaccagcttagttccacaggagggagaagaatcaggactcatttaatccataagaattaaactcagcagcttttgagtacccattatgtgcatagtctgccatgaaatattataaagtagtccaggtatggtggcttacacctgtaatatcagcactttgggagaataagacaggaggattgcttgaggccagagtttgagatcagcctgggcaacatggtgagatcctatctctacaaaaaattaaaacatcagccatgtgtggtgtacgcacctgtagtaccagctactaaggaggctgaggtgggatgatcccttgagtccaggagttcgaggctgcagtgaggtatgatcgatcacactactgtactccagcctgggcaacagaacgagaccctgtctcaaaaaaaaaaaaaaaaaaaaagttttnaaaaaatttttnacctttngggg

SEQ ID NO: 22764 - DNA, 764 bp, Homo sapiens
  misc_feature 2, 10, 16, 669, 685, 724, 763: n = A,T,C or G
anacgacagnaagggnattctatagctccaacttaaggtgcctttttaattccctacagttttatgggtgttatcagtgcttgagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaatcccagcactttgggaggctgaggcaggcagatcatgatgtcaggagtttgagaccagcctggccaatatggtgaaaccctgtctctacaaaaaatacaaaaattagctgggcatggtggtgcgtgcctgaagtcctagctactcgggaagctgaggcagaagaatcacttgaacctgggaggcggaggttgtggtgagccgagatcgcaccactgcactccagcctgggcgacagagcgagactctgcctcaaaaaacaaacaaaacaaaacactcacccatcaacgaatatagactcttctctcatttatcgatgatcctctttttcatttttaagtacttatgtggaagctagtctccaaacacatctttanagagaaagactgaacnactccaaattccattaatcatctgttttgcttggataanacttgacagtttttttaggactgcaatggcctaatatana

SEQ ID NO: 22765 - DNA, 761 bp, Homo sapiens
  misc_feature 1, 9, 27, 529, 582, 595, 618, 641, 666, 727, 748, 755, 759,760: n = A,T,C or G
nacgacagnaagggaatataaaccagnaggaagttattgccaccaatctctacctctatggttctaagatcacaaacaccagccctcgatgatcctatggctttagttgccacccatggtggacattgtagttgtctacccaaaattcatttcactctctgctactgtgtagtagccatgtggtttggatggaactgaccagagatggggcctgattaggctaagccagtggttctcaatcctggcccattgggattacctaaggagcttaaaacaaaacagaaaaaaatcagccaaccaaatcctcctccctgaaatgcctgggagtggggcctggatgttggcactttctagatacttcccaggtgagtctaatgggcagccagtgttgagaaccactggtctaccatcttccctgccactggcattggttcaggaaattcacacctatgccagttagcttttgccattccccaagctacaggaactggttgtcgtggttacaatcaacataatcagggtagctcangactttcgttttatagacatagaaaagtactcagtctcctctctttgtatgangaaatcctgccgnggatgaaattgtactttgaaganggcagaatgacagatttgaaganatagaaccaggccctgattaactgnttataccccaactttcagtttgtgaacaataatctgcttatattaattggctttgaactgngactagtacccaacttacttntattgtntatnnt

SEQ ID NO: 22766 - DNA, 788 bp, Homo sapiens
  misc_feature 3, 32, 38, 42, 53, 192, 193, 194, 195, 348, 349, 350, 351,352, 376, 516, 538, 559, 687, 702, 725, 729, 733, 742, 753,758, 764: n = A,T,C or G
agnacgacaggaaggggttttctttgataagnggggtnggtngtgtaaaagtncctttatttccaaaataaattttacttagaaattatatattcctaataggtgtgccaagccatttgaatgtagactatatcaaagaagccttgatgaaaatagaagatgtatattcagtcgaagatttaaatatctggnnnntcacttcaggaaaatctactgccatagttcacatacagctaagtatgttgctggtagtaaatgtgggcctggggttggtggacttctgcctttgaaactaaacatccctgcttataattatgtaggaagacttttctgctgaaaagatttgtnnnnngacaaaagcctttgtctttaaaanacaaaggcttttgttaacagccttaaacaaaaggctctttaaagggtaagttgcaggtcagtattgataccagaacaataattttctatctctttgagatattacaaactgattttaaccttcagattaaaggtattaanaatatttcctgactggcatggnggctcgcacctgtaatcctancactttggaaggctgaggcgggtggatcacctgaggtcaggagtttgagaccagcctggccaacatggtgaaaccccgtctctactaaaatacaaaattagctagcgtggggggcatgcctgaatccngctccttggagctgngcagaaaatgcctgactcttaancggnggtnatgacccanatgcccctgcnctatntggggncaacagactctccggaaaaaaaat

SEQ ID NO: 22767 - DNA, 731 bp, Homo sapiens
  misc_feature 5, 632, 682, 697, 727: n = A,T,C or G
ggggnatggcaggtttggtggggcaacaggtagcagtggaactagtagaaaatattcatgggcagcgggacccatggtgaagtcactgtgttcttctctccaccctcacccaatagagatttaggtcaaaggagtaatggtgactacaagaataaggccttccagaatcaatctagaggtggatgccacagagatccagtggttcagatttttttctgaggtcactctgaaagatttctcctgtaaaacagtcagctgcttgtttctgtcttgtgatagtagctgggtagcttcctttcctctacaggaactcttactaggttccatcttcctgtccgtgattgaacttctggactctcctaataagttctctctgcatttttatgatgtagtgcttcaggtaatcagccaggctccctgcaggcctcttctacctgcctactgtctaacaaataggaaggctgggcacagtggctcacacctgtaatcccagcactttgggaggccaaggtgggtggatcacgagttcaagagccatcctggccaacatggtgaaaccccgtctctactaaaaatacaaaaattagctgggccgtggtggcacacaccctgtagtcccagctactcaggangctagacaggagaattgcttgaccccggagtaggaggttgcagtgagccnaaattgtgccactgnctccagccccggtgacagagtgagactccntctc

SEQ ID NO: 22768 - DNA, 699 bp, Homo sapiens
  misc_feature 9, 36, 557, 562, 607, 609, 642, 680, 699: n = A,T,C or G
gggaacagnaacagtaatagcattgtgtctcatggnaggtcctttttttctcacttcatttattctcatttaactatattaaattatagttaactaactttattatccattagatgaggtgaaacaatcactggcagtagatggaaaggacagaaagttctacaccagtgtagctcatgtggaggtcctcttgccacagtggcagtgatgagaccatacacggatacgtgatgccgctgctgctcccttgattctgatctggatctggttgcagattcttataggagatctccctgcagcccaccctaaagaccccaggccccagctctcccactacccagcagcccaacctctgtgtgctgcccggagtcgggaatggagcatctttgcctcactgtctgaatttgtacaagttgtagaactgcagttgctaacttaggttgataaagccttgatttagattagattttgattacccggaggactcctcttacctactctcatagcagcagattggccagagtgttggtgatttcctttcaggtaggcggtaagangccanggatgcacattctcatgcctcgattgcttaccttgcatgccccanantcagttccagctgggctttgggacagagcatanggcaggcccactgctctggcttttgcaatggccatcanaagtcagaaactgatttan

SEQ ID NO: 22769 - DNA, 751 bp, Homo sapiens
  misc_feature 1, 9, 15, 583, 597, 696, 702, 703, 705, 714, 718, 722, 723,724, 725, 727, 735, 737, 738, 741, 745, 746, 747: n = A,T,C or G
nacgacagnaagggnatgggaatattctgtttctggaacataccacacccaatgcctccaggacctaaggctctttaaaagaaaaacagtgcttaaaaaattataagcgttatacacaggctgagcacagtgggctcatgcctgtaatcccagcactttggaaggctaaggcgggaggattgcttgagcccaggagttctagatcatactagcctgggtaacacagtgagatcttatctttactaaagataaaaaaattagctgggcatggtggtgcacacctgtagtcccagctacttgggagactcaggtgggaggattgcttgagtctgggacattgagactgcagtgactgatgatggcaccactgcactccaccctggacaatagagcaagaccttatctttctttttttttgagacagagtttccctcttgttgcccaggctggagtgcaatagggcgatctcggcttaccgcaacctcctcctcccggattcaagcgattctcctgcctcggcctcccgagtagctgggattacaggcatgtgccaccacactcggctaattttgatttttagtanagacggggtttctncatgtggtcaggctgtctcgaactcccgaccttcggtgatccgccacctcggctcccaagtgctgagattaaggcctgagcccccgggcccggcggctnttttgnnanaaaaaaaanaagnaacnnnngncggtttcngnnccnaggnnnaaat

SEQ ID NO: 22770 - DNA, 776 bp, Homo sapiens
  misc_feature 1, 9, 603, 708, 747, 749, 750, 752, 762, 775: n = A,T,C or G
nacgacagnaggggaaaaatggggtaggaggagagtatgaatcagaggatgaagtaactcacaatttaggctataggggccacatttttctaactcaatattccatgattatttccaaaggttacttaaatccaatatatgactcagagcttcagacttaacgtcatacattttcacataggttttaatttgtggagaaaggacatattctgatattattatagaaaagccattggattctatggtgtgataataagagatttcaggtctgggtcttctctatcagtcagcttttgtattgcaataacctacaatctcaattctcaaaggcttagagcaagatcatttgctttttgttcatctgaggactgccgggtgagtttgggttggctgggctcagtttcactgggcttttgattccaggagcccagagtgaagcagcagccactatcctgcagttttcaacgcagaggacataccaggggagacagaggctgagccaaatcaaataatcacattgaaaccttttgcttaatcataccaatgtcatggctgctcatattcattagccaaagcagccacatgacttggcagaagtcatanggttctgatgcttattcctccatagatgaacaggaatctctatacttaattgacttatcaaatccattgctggagtggggaatagctgggatagtaatccctgtntactatgccacaatgatcagcactttcagtttctctggnannanagcctgcttntggaagcctctcnt

SEQ ID NO: 22771 - DNA, 788 bp, Homo sapiens
  misc_feature 1, 9, 109, 695, 704, 735, 750, 754, 764: n = A,T,C or G
nacgacagnaagggggagcaactgaactggaaacaagcatgcaggaccccaacgcagacactgaatggaatgacatcttacgcaaaaagggtatcttaccccccaaggnaaagtctgaaagaattggaagaggaggcagaagaggagcagcgcatcctccagcagtcagtggtgaaaacatatgaagatatgactttggaagagctggaggatcatgaagacgagtttaatgaggaggatgaacgtgctattgaaatgtacagacggcggagactggctgagtggaaagcaactaaactgaagaatgaattcggagaagttttggagatctcagggaaggattatgttcaagaagttaccaaagctggcgagggcttgtgggtcatcttgcacctttacaaacaaggaattcccctctgtgccctgataaatcagcacctcagtggacttgccaggaagtttcctgatgtcaaatttatcaaagccatttcaacaacctgcatacccaattatcctgataggaatctgcccacgatatttgtttacctggaaggagatatcaaggctcagtttattggtcctctggtgtttggcggcatgaacctgacagagatgagttggaatggaactgtctgaatctggaccattatgacagacctggaggaaaccctagagccgatgagacgtgttgctgnctcatgcgngctctgtctctgagaggacgcgattccaggngactgagctcagctnttcnatccgacttntggacaatggctggttttaaaaag

SEQ ID NO: 22772 - DNA, 785 bp, Homo sapiens
  misc_feature 1, 9, 642, 732, 758, 764: n = A,T,C or G
nacgacagnaagggatatctagttatttttttctacttttcaatgtttctccctatctttctagaattagttctccagttgtctttttccttttaccttatgttgttttatcttcaaagacagagtgatggagcttagtaaggatgctatgatttgaagaacacagatgcctctaacttatggaagaggaagccaaatgctgttccacattcagataaacagatgaatggatgcaaaagtttctccctataagatgtgtttgtagttctgatgcataagaacttttccagcatgctaagggggttgaaaggtactgtattagtttgttttcacactgctgataaagacatacccgagactgggcaatttacaaaagaaagaggtttattggacttatggttcaacatggctgggaggccacacaatcgtggaggaaggcaaggaggagcaagtcacatcttacatggatggcggcaggcaaagagagagcttgtgcagagaaactcctgtttttaaatcagatctcatgagacccatttgctatcatgagaacagcacgggcaagaccctccccatgattcagtcatctccatggggtcccttcacaacaatgggaatatgggagctgcaagatgagattanatggaacatagagccaacttgtcaggtaggaagcagattcaggaaataaattctctgtctgataagagtcctaatccccctgtatctcanccttggaggccaggggcaatctgagncagaancaaacctctgctaccgggaac

SEQ ID NO: 22773 - DNA, 683 bp, Homo sapiens
  misc_feature 4, 179, 218, 257, 341, 351, 378, 542, 575, 602, 610, 615,626, 644, 649, 654, 658, 663, 664, 665, 677, 680, 681: n = A,T,C or G
gggnacattgatttcctttagtgtatctaatacatatcacctgaagaaagtgactcatatttaatataattttccaaaggacaaattaaatctccaggaatcattctgctattgacatcactttttttttttaacaaagctgaaatttattattgaggttactttttaacaaagctganatttattattgaggtcttgccttaaaaaatgattcatanaaaagtccattttgagttaaatctgagtttgagtcccanatccttttttcccttctattttctggagtagggcttcttttggtcttaatttttaaaatttttattctattttagtttattganacggagtctntctctgtcacccaggctggagtgcagnggtgtgatcttggctcgctgcagcctcaacctcccaggctcaagtgatccttcctggctcagctccccagtagctggggctacaggcctgtgccaccacacctaggtaatttttgcatcttttgtacagatggggggtttaccatgtttcacaggctgatctanaactcctggacccaagggatctgcctgcctcancctcccaacgtgctggggattacaggngggagccnccacncttggcttttnggccttactttattttgnaattnggatnccantttannnccttcaaaaganggnnaa

SEQ ID NO: 22774 - DNA, 658 bp, Homo sapiens
ggtcatgtgtcactgaatgatagggatacattctgagaagtgcatccttaggcaatttcatcattgtgccaacatcacagagtgtacttacataaacttaggctacacatctaggctatatggtatggcttgttgctcctagctacaagcctgtgcagcatgttactatactcaatactgtaggtcattgtaatgcaatgtaagtatttgtgtgtccaagcatatctaaacatagagaaggtacagtaaaaatgcaatataaaagataaaaaaatgtacacctgtacaggccacttactatgaagagagggagcatacaggactggaaattgttctggggaggtctgtgagtgagtagactgtacactactgtagactttgtgaactgtacacttaggctacactaaatttattttaaaattgttttcttcaataataaattaaccttagattactagatgacaaccattgtacatgccatccatcattgatggaaacatcgttatgcaggaccacatacatgactataatgaggattggctgtcttttaaaaatgaagacttaatttttaaaaccaacccctatgcagttattacacttttattctttaagccaggggggggggctcacgcctgtaatcccacgctttgggaggcac

SEQ ID NO: 22775 - DNA, 517 bp, Homo sapiens
  misc_feature 502, 508: n = A,T,C or G
agcttatgatataatttcatctcatccatcaataaataagaacacacaggtgtcattctccccaaatgagaaatggaaaaattgaggctctgtaaggttcagtaccttgcttagtgttacctaaataatcagcggttacatcaaaaccagaactaagtttgatgtctagaagctacagaatataattttcaggaccaagtggaacaagttatgttcagtttgattttaatgcatttcagaatctggacaacatcttacaaaatgtctgattatatcctattttttctgtagatttctagaaagggaattacaattgggggtgcagggtaaatctattttctgacagtggtatgcctttgctcttacaatcttatcagctgaattgagggaaaattcatattccatgtcaattcatgtaggcgggtaatgtccggttgcagtatattcacaaatatactttcttgctgggggttcataaagtcctacttcacagccacaaggnttgtanatctttgac

SEQ ID NO: 22776 - DNA, 831 bp, Homo sapiens
  misc_feature 2, 4, 15, 16, 20, 40, 44, 46, 47, 49, 57, 513, 556, 656,657, 741, 754, 761, 765, 780, 786, 807, 811, 821: n = A,T,C or G
antntcttggttcgnnaaancttgctttttttcttttggnccgnannanacgacagnaggggccagttttcaaaggggaatgcttccagtttttacccattcagtatgatattggctgtgggtttgtcatagatagctcttattattttgaaatacgtcccatcaatacctaatttattgagagtttttaacatgaagtgttgttgaattttgtcaaaggccttttctgcatctattgagataatcatgtggtttttgtctttggctctgtttatatgctggattacatttattgatttgcgtatattgaaccagccttgcatcccagggatgaagcccacttaatcatggtggataagctttttgatgtgctgctggattcggtttgccagtattttattgaggattttgcatcaatgttcatcaaggatattggtctaaaattctctttttttgttgtgtctctgcctggctttggtatcagaatgatgctggcctcataaaatgagttanggaggattccctctttttctattgattggaatagtttcagaangaatggtaccagttcctccttgtacctctggtagaattcagctgtgaatccatctggtcctggactctttttataatgtaacatttctacatgctcccanngatgctaatgctgagactgatctatggacccacattgagtagcatatttaacttgatcttatgaagagtctaaaaattccactntttaaaataaaancccttanaganaaattaaatttaatngattcnattttttgggtaaaaaggtanaggntctgatgatnacaaatcaag

SEQ ID NO: 22777 - DNA, 766 bp, Homo sapiens
  misc_feature 643, 655, 674, 755: n = A,T,C or G
ggggggctaaatgacttttcttaattttaggaattatatagtcagtggcagaaaagtggccaattttttctggaatcaatagcacacaatataacctgggatcccacaggtaagaaaataagcaggattaactaaaatgaaatatcacttgcctagttgttcttatttttattactcttatgtatttcacttctgctgggtgtgaggttgtggggaataccaaagaagtaaaatggattatgcccttttagagtttatactgaaatgaagacagatatgcactgtaagaaatgagagaatgttctaagtgccataataggatacccattgtttttggaaagagatatttctctggagaattaacgtttcattgaaaaggagcctttggacctgagagtaaacagactttagcaatgagagttgggtagatggaacaggaaaaaagtgaaatttaagaaaatatatgccaggcgtggtggctcacgcctgtattcccagcactttgggaggctgaggtgggcagatcacctgaggtttgggagttcaagacccgcctgaccaacatggagaaaccctgtctctactaaaaatcaaaaaattagctgggcatagtggcgcatgcctgtatcccagctcttgggangctgagctaganatcgtttgaccttgaaggngaggttgcagtgagctgagctctgccttgccttcacctggcacagagtgaactgtctcaaaaaaaaaaaaaaacctgggcncttttcctaac

SEQ ID NO: 22778 - DNA, 788 bp, Homo sapiens
  misc_feature 1, 9, 618, 744, 756: n = A,T,C or G
nacgacagnagggatttcaagcaaatggaaaacagaaaaaagcaggtgttgcactcctactttctgacaaaacagactatgcgaataaagataaaaaagagaaggacattacaaaggtggtcctgacctttgataaatctcattgcttgataccaacctgggctgttttaattgcccaaaccaaaaggataatttgctgaggttgtggagcttctctcctgcagagagtccctgatctcccaaaatttggttgagctgtaaggttgattttgctgtacaactccttttctgaagttttactcatttccaaaaaggaaggcaagttttcctgcttccatgacgatggagagcaggcatctcctttcctgagtttcagcttgcttctgacagggaaggtaaccactgatccacttccagtcactatccatgagtttttatttccagatacatgaaatcatatgaaagtggatgaccgggccaccctccaccactgccctgtaagaccatgggacacacaggccaccagttcttttcatgtggtcatcccctgttagatgggagaaaatacacctgcctcatttttgtaccttctgtgtgaacattccacggcagagcttnctaaatgtggatgatgaattgaatgaatgaatgaattgagagaaatgattaatggttcaatcctggctgaaagctgtgtttaagatggtggtaaagaaggtctgttttctgccttaatcctattgnacttgggcaganccagcttgatgcaaccactgacttatttgctt

SEQ ID NO: 22779 - DNA, 700 bp, Homo sapiens
  misc_feature 2, 10, 591, 613, 676: n = A,T,C or G
anacgacagnaaggggtggatgaaacttcgaatgaggattgttggtgagagttggattgttgttgtatgaggaagtgcaccttggaatctaatggggtcttcacggaggggaagtcagttgtggcactgtttgtgtattccattcatcattcatccctccatccaagcacccacgtggagctcagaaagatgactaacacataccccctgctgctcctgtttttctaaggtgtgctgggaccatttacatttagttctttggagaacacaactacttaggatttttgttgttgttgttgttttcctgtacattgtcttcctatctcccttctggtacccattccaccctctctccccttcctcactgctgtttcataggggttctcagattcctgtgaataaagcaaaccgatgtgcagatatgtgtgcttacacatgtggacgtatttgaggaggtaagagggacctgcacaaggctttagtgagtaagcagagaagttatttatatatagtgagacccagtaaacggtgatgtcgcaggtgagacagttgatctggtcagaatatgcctccagagacatcactggtgangcctgcatgcatgttgaaaaantgtatcttacatctaggcttgggtttcccctgcactcacttatgaataacaccgtatgcaaanattgacttttctgtcaatgaactg

SEQ ID NO: 22780 - DNA, 584 bp, Homo sapiens
  misc_feature 397, 401, 550, 552, 557, 563, 566: n = A,T,C or G
ataaccttgacagttttgaggagtactggtcaggtgttttgtagaatattcctcaatttgggtttgtctgatgttttcctcatggttagagtggggttatagatttttaggaagaataccagaggtgaaggtccttctcactgcatcatgtcaggagttacatgctatcagcttgatggtgtattaactttggacacttggttaaggtagtgtgtgttggttttttgctgctgaaaattactgttattttccctttccatacttctgttctttggaaaacagtcactaagtccagtcatgggaggtggtgggtgggaaagattacattcaaccccctggaagtgggaatatccatatgtagtatttggaatttttctatatggaaaatttgtttctncctnccaccctaatttgttacatcagtatggactcatgtatattttgattttgggtacacagtattattttgtgctaagttgtcaacttgctttaagagtctgcaggtggctctatgtcctttgaggcctcctttgattttgacctttacttngnctcanagctcngtntttggatttctgcccacc

SEQ ID NO: 22781 - DNA, 762 bp, Homo sapiens
  misc_feature 2, 10, 667, 688, 690, 713, 715, 719, 756: n = A,T,C or G
anacgacagnaagggggtgtgatcttggctcactgcaacctctgcctcccgggttcaagcaattctactgcctcagcttcctgagtagttggtattacaccaccatgcccagctaatttttgtatttttagtagagacagggtttcaccatattggtcaggctggtttcgaactcctgacctcgtgatctgcccgcctcggcctcccaaagtggtgggattacaggcgtgagccagcgcacccggcaacaataacatttaataggcattgtctcattctaatgatatataccttctacctagtgggcactttgtacatatttattttttattttatttattcattttttttgagacagagtctcactctgtcaccaagttggagtgcagtggcacaatctcagctcactgcaacctccgccttccaggttgaagtgattctccagcctcagcctcccgagtagctgggactccaggcacgtaccaccatacccagataatttttgcatttttagtagagacggggtttcaccatgttggctaggatggtctccatctcctgacctcgtgatccgcccaccttggcctcccaaagtgctgggattacaggcatgagccaccacagctggccgtaatatttttgaattgaatctgtttggaagccaatntgtttggaagccaacattaananagtaaatttaacctataggttcnanattntcccaattgttttgttggctgggtataaaataatgangtcttc

SEQ ID NO: 22782 - DNA, 787 bp, Homo sapiens
  misc_feature 2, 10, 597, 639, 679, 684, 720, 725, 735, 743, 747, 759, 778: n = A,T,C or G
anacgacagnaaggggttattggaaaatttcaatttgtcagtttctcagcttggaaaagtcacctgaatgactcccacacctctacccactcatctccctgtcttgtggggggtatctgacctctagtactggtgccaggaaaggtgatagaacagtggttctcaattttgatttaattcatatgaactgtggctcgggcatcagattaaggcacatcaggtgattatggtgtacagccagggttgagggtcactgtcttcaaggaaacttctacacctcttacacagtggtttcacctgcagaaggaggcacctgtcctagactgctctagtgttcacaaccaatgataaatctgctgtgggtggagaatgcttgttgagccaaaagcctgcatccttcttgcttctgtcttgactgatctcatattccttcttgggcatagctcttggcaagcagtaaatcttcactctcccactgccgtcagccaagtgttcattttgtccaccacaaagataggtgtttttgggatttgataggttgcatgaaggaagcaaatagaccgtaaatgcagaatctctgtgtttacttggaaacangctagtcattgacaacacctttaagatagattttctttgaanaaagttgctgggtatgaactgcttaaaagtgagcccaagncagcncagtgtcttgacctgtatccaccctttgggagccanacgcnaatacaggcnggagtcanacanacactgaccagngggaacccgcttctaaaancaaataaca

SEQ ID NO: 22783 - DNA, 755 bp, Homo sapiens
  misc_feature 511, 655, 712, 736, 744, 754: n = A,T,C or G
ggggagaatagaatggttgtggccatttttgctcagaatcttcccaaaggctgataccattttacatcaatctgaatgtctactttactttatcttctcatctcattttttaaaaattgaaaaaatgtcctaccaattttatgaccctttttagcaccccccaacttcagatcactgaaccaggtattttttagagataagaaatgaacaaataatgaagtggtatgtcccaccttcaaagatgctcctgcaaacagaaagaaataagaaagagacttgagaggctgtgagacagggacagagagacagaggccagggcagcatgtccaggagtggagtccaccacccaccaccacgatgccagagagctgggacaaggatgtgtaccccaagtccccatgccctcgctgcaggccttgctccccaaacccatcacctacttgatgaaggcctttgacctcctcatggcctttgtgagagagagtttataaaggggcagcatgtgaagaangtattactactaccactgggagtatcgccacatgccagacatcattgaatgcaaggaggatgttttgtgcatgtttggagctgaaatgcaatggagaagggaccacaaaatcagtcaagaaattgttgacctcatccaggagangcttaaggagggagctacagacagactgtgccaaggagctggacccttcaccctggnggccaaggcatgccaggaccgctntctaccanggagtcactnt

SEQ ID NO: 22784 - DNA, 730 bp, Homo sapiens
  misc_feature 1, 3, 22, 42, 494, 550, 583, 586, 597, 645, 650, 656, 694,728: n = A,T,C or G
ntnggggattcttgtgtctcancccactgagtagctgggatnacagttgtgcaccaccatgcccaactaattttttctatttttaatagaggtgaggtttcactgtgttgaccaggttggtcttgaactcctggcctcaagcgatctgcctgcattggcctcctaaagctgagtttacaggggtgagccactgtgcccggtcgcccccacgttgcaataacatcagcctgtcaggttgtttgtaattcaggtagcaaattgatttttgggagcactctgggtctgttctgtaaagtaactttatttttgagcaaggatccttaatctctggcctggagatggtccatgtccctctcccccaccacattgtatgaaaaattgatgtcatacatatggatcctttttttttgagatagattctctcactctgtagcccaagttggagtgcagtggcgcaattttggctcactgcaacctgcaacctctgcctccanggctcaagtgatactcatgcctcagcctctcgagtagctgggactacaggtacccnccaccacactcggctaattttttgtattttagnaanatggggttcancatgttgcccagggggggctcaaactcctgagctaagcgatccgcccnctcancctccnaagactgcattacagactgagcccccccccagctcatntggatcattttagggggggactggaatatcctanat

SEQ ID NO: 22785 - DNA, 675 bp, Homo sapiens
  misc_feature 1, 9, 41, 583, 615, 648, 654: n = A,T,C or G
nacgacagnaagggggttgtgtgggttaaaattaccctagnaaatcaggtatttccaaatcaatgagtaaagctgtattttaaatattttgaaggtataaacttgggggttttgtttggtggattattgtgtttgggtttttttttctttttcttttctaaaataacgaagcccttgatcaagcagtaaaaccttaattatgaccagaagtacaagataacacatgatagtaataccattgcattatgcacatggctcttgttacatgtttggactacacatgtggcactagagataatacaagttttctcatttgtatctctgtcatgtacaccaatgcagtgatctttttcaaatgcttggtttgattgtctctaagcccttcatgctaaagggcaattatactactttgtgatagtttttttccccccactttgtcacccaggctggaatgcagtggtgtgatcttggctcactgcaacctccgcctcccaggttcaagcctcctgtctctacaaaaactgtagccaggcgtggaggcgtgtgcccatagtcccagctactcaaaaggctgaggtaggangatctcttgaccctggatttggaggttgcggngagctgacatcaccccctgtactccttctgggnacaaanaggggaccctgtccccccccc

SEQ ID NO: 22786 - DNA, 696 bp, Homo sapiens
  misc_feature 496, 504, 508, 514, 534, 606, 618, 637, 641, 649, 655, 660,695: n = A,T,C or G
aggtacctgggagaccctaggaatgttgatatatagatatgaaactccataaaagtgtgatcacctcatcacctataaaaagttgatctgggctgactaatcaatatttggaagtcagaggcagtaaaatgacaaataaaggccttgggtgatgatgagctctctcagggaaaatgtttaaactgcaacaagagaagaaccttagggaagtatcaacatttaaggaatcagttggaaaatgggagcctacacagtagactatgaaggaccaaccaaaaagaacaagaactgggtggtatcatggaaacccagggaagagagggcttcaaaaaggaggatgtggtcagctgtagtgaatattactgagagattgtgatggctgaggcctgagaagagactactagttttaacaacagtgttgttggtaacattggtcataatagtttctctgaaggggtgaccagagagctgcaagaatgaggagaggtgagtgcanaagtgaanaaangagcanagacacacttgtaagtttcnctgtaatggataaaggaaccaggtctaccaaggacatggttgagaggcctttttctttttatttaaaaaganacccttgagtgngttgaatgctgtggaatancaanatgagganattgangtcanacaagggaaaaaaaaaaaaaaaccccggcccttcnc

SEQ ID NO: 22787 - DNA, 650 bp, Homo sapiens
  misc_feature 235, 267, 268, 524, 578, 606, 636, 643, 645, 646, 649: n = A,T,C or G
gggggatctaacttgcttttcagaagcacgtgactggcatatttgggtcattaaatataaagacattctgcttatgaattatgccagcaagatgttttcagatcatacaaaaacaatgtgtgtggtgactgccaagtagtgtttttatgtgtatgtctgtacacaccacccactgatctatgcaaggcagtggtgctttgcactaaatgccacatcgttccttctgggatctcanaacctttcataaacagtcacttaagactctanngagttaaataaataataagatccttacccccttgaaaagaatatgtagcctacatattgaaaaattaggcaatttagcccaaggcagaatgagcagagaaagcatgacctggtgagccagacctaagtgccagcagcaagaattttgatctgtaaacattctgatgatggcagatggcagtgcggccttgagaggggctttcagtcaatctgcaaccttttattctgtacctgataagtctctggtactgagttanaagctgtgaaaggccaagtgtggtggctcacgcctgtatgccacactttgggangccaagcaggaagttcgcttgagcctantttgagaccacctgggcacctgggaatgtntttttancnnccnc

SEQ ID NO: 22788 - DNA, 161 bp, Homo sapiens
  misc_feature 134, 136, 137, 138, 144, 146, 147, 148, 149, 151, 152, 153,154, 155, 157, 158, 159, 160: n = A,T,C or G
gggggactagggggagaaactgaaagctgattaattacaggaggtttgttcaggtcccccaaaccaccgtcagatttgatgatttcctagcaggacttacagaaataaagagctatcatgctgtgaaaaaaaanannnataacntnnnntnnnnnannnna

SEQ ID NO: 22789 - DNA, 775 bp, Homo sapiens
  misc_feature 488, 655, 713, 743, 749, 764: n = A,T,C or G
ggggatctgattagaacttccctcatttttaaaatgcttcttgacatggtttggatttgtgcaccccccacccccaatctcatatggaattgtaattgtcagtgttggaggaggggcttgctggaaggtgactggatcatagaggtggtttctaatggtttagcctcatccacctcgtgctgtctgatgataaagttctcctgagatctgcttgtttaaaaagtgtgtagcacctcccctgactcttttcagccatgtgaatatgtgcttgcctccttttcaccttctgccatgattgtaagtttcctgaggcctccctataagcataagtctgtacagcccacagaactgtgagccaattcaatcccttttctttttcaattacccactctcatgtatatctttataacagtgtgagaacagattaatacactcctcctcagaaagcattcaatttagttgtgtctaaagtatgccaggtgttctanggtgttatcttagccaataattcttcctcttcagcaagatctatttgcctatgacagcttgacctacatttcctaccatacttgtcagtaacaagtagcccataacatctgaatggacttcattgaaatcacagaggttctttagttctctactttattagcaggcntccggaaacacatcaactttctaattaataagggcctgtgctttgaaaactgctcaanaaaaaggaaagctacttaagattactttanactggntgctggtcaacctgnatctaccttgg

SEQ ID NO: 22790 - DNA, 732 bp, Homo sapiens
  misc_feature 5, 451, 688, 705: n = A,T,C or G
ggggnaatagttgaattggggctcaatacatgtttgctaaatgatgattgcatttaactgtgagcagctttttcagatattaatcaaaatgcctgcaaagactacacagttgcaagggacatcagcttatatcccaacattattggttcctgatccatagttgtgagaccttggttgattccctgatagtacagcaactccctgggaatggaagttcaacttgttggctttagaacaacataagcagtttcattgaacattcactgaatgtctcctctgtgctgagcccatgtcagggactgggtctttaatcatgtccttgtatgcagcatccctgcactctacctgcacatgacttctgaacagcatgctctgcccagacagcctcagtgagggccaggacttgaaccctgtggaagcatgtaaagacatatttccgtggtggcagaangctgagagttcagcatactgtctgtcttcacttttgagttgttctttcatctgcctaagactcatggcagagcactcatttcacaaactttcactgagtgccgactatgtgccaggcactgtgccatgtgctgaaagtacaaagactttaatatgtagtccttgacctcaaagagctcaagagtaattgacagaaattcctagatcatgatctgtgatgatgagaatcattccttanaaggcttgcatataaantatttatatacttattttgtaggaaaa

SEQ ID NO: 22791 - DNA, 732 bp, Homo sapiens
  misc_feature 626, 628, 691: n = A,T,C or G
gggagggtattagtccgttcttgcattgctgtaaagaaatacctgaaactgggtaatttataaagaaaagaggtttagttggctcatggttccacaggctgtacaggaagcatggctggggaagcctcaggaaacttacaatcatggcagaaggtgaaggggaagcaggcatatcttacacggccagagcaggaggaagggagaaaatgggggaggtgctacacattttcaaacaaccagatctcatgagaactcactcactatcatgagaacagcaagtgggaaacacacctccatgatccagttacctcccaccaggtccttcctccagcattggggattacagttccgcaggagatttgggtggggacacaaatccacactacattagctaatcaggaaaggtttcatggagtagatggtattctaattgctgaaagagagggagggtcgtctagaaattgggaatggtgaggaagcctctgaggagatgttggaagctgacagtggaggtgtgcagtggtgggcaggcagccaggaaaggcaaattttggaaagccttggcagacagacgtttctctgtagagtaaatagtgacagagatgtattagaaatagtaactaaangntttatacctggcgcattgaagacgggagaatcatgaagcacaattgacaagcttggtattaangggggttatgagggaaaggaagcttcaagatggctcatctc

SEQ ID NO: 22792 - DNA, 358 bp, Homo sapiens
  misc_feature 280, 320, 354, 356: n = A,T,C or G
gggggctttattgataagacgcaaactgttgaatagctttttataagtttaacatgctatgagtgatgtgctgaatgaaccctacacatcaccagctccaggtaggcgctgctgagttgaattgaggcagacctattggttatactcacgtttactctgtcactacacaattttgagtgtgtttgtttagtgtttctaagcttattttaaaatttacagtcagtaaaagtatttttacttggccctttcctaattgcaggtatgtatctctacgagttangaaatattgctcaatttggttacctaaataaatattttgnggtcattcgaattctttttttttttttgaaaagnantt

SEQ ID NO: 22793 - DNA, 631 bp, Homo sapiens
  misc_feature 597: n = A,T,C or G
ctttagtcagattgaataagaaaaaaagagagaaaattcaaattatcaaaatgagcaatgaaaatggggccatcactacctaccttaaaaagaattttcaaaggattaaaagaaaatgccattgcattagttcattctcacacaactataaaaaagctacctgagatggggtagtttatgaagaaaagcgctttaattgactcacagttccacagtctgtacagcaggcatggatcatgaggccttaggaaatttacatcaggtgaaaggctaaggggcatggaagacatgtcttcacacggcagcaggagagagagcaaagagggaagtgccacacacttttaaaccatcagctctcatgacaactcactcactatcatgagaacagcaaggggaaaatctgccctcatgatccaattacttcctaccaggtcccttccccaacactggaaattacaattcaacgtgcgatttggattggtgtgacacagagcaaaaccatatcaaccttactgcatatgccaaaaattttaagcaaatgaaagctaccatttaaagttccggatctaccattttaaagttattgcttgtcagctntacccaaaattatgattgatgagaatcatgagag

SEQ ID NO: 22794 - DNA, 671 bp, Homo sapiens
  misc_feature 536, 575, 593, 648: n = A,T,C or G
gggatctcttgcttggattattagtctctcaactggtctttctgtttccatccttcacaagagtgatcttgttaaaacagattattttatgtcatctcttcacttaagattctctgtgatgagttctttaccccactcagagtaaagtctaattagtgtaatactgtaccaggttctacagggtctggcctctcattccctctcagacttcatcttctatttgctctttctactcagttatggtcacactggcctctttgctgttcttgaccacacctgcacactcctgcacctgcacttttatacttcttgttgcctctgcttggattgctcttcccctgatgtagaactgtatgtgaacttagtctaagtaaaacaaaacaaatcctaacttaccctatttaatcatgcaatcttcctctttgagtctgtaacctgtatacctttttcatgttttattttttctccaaagccaattgtttgtctgttattatgtttctacttcctgctaggacacgttttgtcttggttcttgntgattactagcacttaacacaatgtctgactcatagtanatttactaaatgtttggnggataaaaggatgaatgaatttttcttaaatatttttgtttaccagttaacatancgatctgaagaaggcatttgatt

SEQ ID NO: 22795 - DNA, 735 bp, Homo sapiens
  misc_feature 532, 534, 542, 586, 598, 602, 613, 665, 676, 695, 706: n = A,T,C or G
gggattctattacttttcccctttgtttatctaaccctaatcccattcctgatcttctgtaagtattcactctaaggtatttgagatactttaaatcattgctaaaaatatatataggatagttgtgtaagtagcagtagaaggtagtggtacaaagcacatattctagagctctagactctggatatgatcctggctcaccacttactagccaggctactggccagtacttactgtagctgctgatcctggacaggctacttagactctgtgtttttcatttctttacttgtgaccctggcatggtatgcaggaaagtactctaaagttgagatttgtgcacatgaaacttagggatttgtgctctcaggatcagaatctgcagaagggaagaaagtaagattgggaagagggtgaatttgaattggtgcagttaaaaaaaaaaagctacacagcgtggcccatatgagttctcaagatgggatggcctttatgagttgtcatcaattggaaaagcagggctgagcttttntnccccaccnttaatcaccatagatgtgagcagttcccaaagggagcataccgngagccaggcggntctntttagctgcanactggacctggaaagggactcaactgtaagcttctgagtgaaaactcttaantacctgagganggaaaaagggggccttgcnccggggttccnctaaatctggaaaaattaaacacaccaaa

SEQ ID NO: 22796 - DNA, 750 bp, Homo sapiens
  misc_feature 11, 13, 14, 35, 43, 200, 202, 205, 639, 673, 719, 723: n = A,T,C or G
tcggctgcganannacgacagtaggggttgaaagnaattggcnggggacagttaatacccagcaaaaattgcaggtgatctcccacacagcacagcctcctctgcagttacgctgtggccttgtgacaatggaatataagagcaagtgatgttcactggtgagagatgtagttcagatgcgggaatctcatctagttgtntnttnttctcccacaatgatcttggagaatgggggttcagttcaagttggtatcagtgaggaaaatgctgcctgggctgcacaggactttacccaagctggaataaacctttattgtcttaaaccttgaaatttgtggctctttctgttggggctgtttgtgctcattaataccaaagacattaaagaagacccaaatgtgggaagttataccctgttcatccatgggaatacacatttccgcaacaatgtcaatgtaatttcaatcagaagcccactggactcttcatgtacctcaacagattctaaaatgtctgtggtagtgcaaagagactggagtagccaagacattccttaagaaaaagctggggggccgggcacggtggctcatgcctgtaatccctgcacttttggaggccgaggcaggtggatcacctgangtcaggagcttgagaccagcctggccaacatggngaaaactcgtctctactaaaaatacaaaaaattagccaggcttggngggngggtgccctgtagtcccagctactcac

SEQ ID NO: 22797 - DNA, 722 bp, Homo sapiens
  misc_feature 14, 16, 541, 625, 631, 635, 646, 674, 721: n = A,T,C or G
gtacggggctcggnanaagacgacagggggtacaattcgatgtttgggttttgtttttgtttttgtttttttggttttttttgagacggagtctcgctccggctggagtctcacccaggctggagtgcagtggtgtgaccttggctcactgcaacttcctccttctagattcaagtgattctcatgcctcagctactcgagaggctgaagtgggaggattgctttagcttgggagttcaaagctgcagtaagccatgattgtgccactctactccagcctgggcaacagagtgagaccccatctcaaaaaaatttattaagttaaaatctttaacagtaaagcaatttggagtcgtattttgcgacattctcaatatagttttccaacttgcattaaaatacattttaaacatttttgaagactaaatttatttttttttaactgacagttatgtttcatttgacaaccttttgctgtatatttttatgtggacttttaggtattgtagtgattcctttaatgaagaaataaaataattgncatttaaaaatgcatattattattaccttatgctataaaaatagttttaaaatagagtatgttttttaagattaaaaataagtntagtcntgcnccgcgtaacancgtttagtcagactgcttaaaattcganggagctgaaaattactggcacccaaatacttaccattgcgttatatnt

SEQ ID NO: 22798 - DNA, 764 bp, Homo sapiens
  misc_feature 1, 8, 18, 21, 110, 660, 712, 744, 748, 763: n = A,T,C or G
ncggcctncggctgcganagnacgacagtagggacttaatgttataaggctattttattttcattaatactttggccaagtgtgttgacaactcccactcctaccccagnacttctttttgtttcatagtgaccatttctgaagtctaagaagtacggctaaagaataatggaaacttactttcattgaaattttactgtataccagtcatttaacataatatttgaaaagagtgctaagttgccatgacatgtagatttaaaagataaacataaaaataacttatatttattatcagtcatggattccaagattatttatgagaacttccaatatacctggcccaggaagaatatggctcctaacttaggggatctcaccagccaatgggaaagactaagcagatgtgtttactggcaatacattctgatgagggacacctaatggtgagtagagggtgcgacggcttctagaaagagtcaaagattagagaagttcatcaggaaaaaacgataaagtttccatcaggagaatacaccctagtaaaggctcaaagtctaaagagtttaaggacttctagggactgaaaaaattctgtttaacaggagggaaggtgggtgtggaagaatagccagaaggaaaaatagccaagaagtcagnggaaggacatttgcatcataggccttgctgagaaattggatgaatgacagtntttgaataacgctttgctcagtttgtagttcnatcnaatgcaacttaaaant

SEQ ID NO: 22799 - DNA, 701 bp, Homo sapiens
  misc_feature 1, 174, 633, 677: n = A,T,C or G
natttcggggcgaccctcttcttggcgtaaaattttcagattgctcttgggaaccatgccgaaagtagtgtctcggtcagtagtctgctctgacactcgggaccgggaggaatatgacgacggcgagaagcccctccatgtttactactgtttgtgcggccagatggtcctagngctggactgccagttagagaaattgcccatgaggccccgggaccggtcccgtgtgattgatgctgccaaacatgcccataagttttgtaacacagaagatgaggagactatgtatctgcggagacctgaaggcattgaacgacagtacaggaagaaatgtgcaaagtgtggactgccgctcttctaccaatcccagccaaagaatgctcctgttaccttcattgtggatggagcagtagtcaagtttggccagggttttgggaaacgaacatatatactcagaaacaagagcctcctaagaaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaagcntgagcaagaggcgactgcaagagctggctgaattggaagccaanaagcgaaatgaagggaccttgatt

SEQ ID NO: 22800 - DNA, 720 bp, Homo sapiens
  misc_feature 6, 13, 578, 697: n = A,T,C or G
gggggnatcttgnacgttcatagcaacagtttgttgttgataaaatgcagttgtgctataaggaagctacatttatattgttttgatactcttaaagtgtccaatctctaggtgtatttgattgggaaaatagtaccattgtggttgaaatgctctgatggaagactcccattataccagcatcagcagtgtggaggggccggccagtaaagtgatctctctctggttggaatatgtagagaaaaggagacaacaccgtcgcccagaagtggaggttgccatattacttgcacaaacctcatgccgttaggtcttcagccacagccgatatttgcagagatgtatctccagcgatctatctccagagatggaacctggagaaatgaccaaacttgacacagccttcaatggttggataaatagctcattaacccaattagtagagaaagctgtgcaatccaagcactagcactgtttgtaggagttattaatggagaacacaatgtattattaaggggcaggggtttttgtttttctttttttggttttaagtcaagagattgtcggccaggcacagnggctcatgcctataatcccagcacttttgggaggctaaggcaagaggatcacttgagctcaggagttagagaccagccctgggcacgtagcgagaacctgtctcttcaaaaaaattcantgaattaccaggcatggtggcat

SEQ ID NO: 22801 - DNA, 674 bp, Homo sapiens
  misc_feature 507, 540, 557, 584, 601, 615, 618, 633, 637, 647, 666: n = A,T,C or G
aggatttcctgtgggattgtctctgctgtccctgacaaaggctctagacaatgggcatgtcaggactggctggattccaccaattcccagacacaagtattttttctcctccatagtttggttcacttaatggccattgcttcctcattttcttgccaagtgacccctccaaccaatggcctcctctctaggctggttggtgatcaacacaccctagagaataaccagcacattcagtctctgggcagatgtgcctctgagtgtgtttcccactggggtagagtggaaggttgtattcctagagacaaactcatgtcccaaagaccttgagtttgctttttctcaaggtgccatgagttatttatttattataggccaaaaaaaaatgtgagcatggtactggtacaaaaatagatacacagatcaatagaacaaatagagaacccagaaataaagccacatacctacagtcaacttatcttcaacaaagtaaaaaaaaaaaaacantggggaaaggacagccttttaaataaaatggtnctgggaaaattggctantctttgcaaaaaaaaaaaactgacttntaaactttccccatgcncaaaattactcaanaanattaagggctaaatntaanacctggcctntaaatcctaaaaaaacttnggaaactt

SEQ ID NO: 22802 - DNA, 503 bp, Homo sapiens
  misc_feature 11, 13, 20, 26, 28, 41, 67, 70, 77, 78, 87, 101, 106, 108,117, 122, 217, 232, 255, 256, 258, 264, 267, 270, 308, 310,313, 321, 332, 340, 345, 346, 349, 385, 386, 401, 405, 414,415, 431, 443, 454, 456, 457, 458, 466, 475, 481, 489: n = A,T,C or G
  misc_feature 500, 502: n = A,T,C or G
ttctgttgggngnaaaaacncccccncnttttgcttttggncacaaacccgctctccggcctgcganaanacgactnnaaggggagnaaaagtcctgtggngtgcntngggcgtgtnttaanaaagatatatagtatgtaaatatattttttagacaatagcttgtaaatgcaatttaattttttttcctcttcttgctgaattttttttttttttncaaattcgggttttnggccccacccgggggctcccccnngnagggcncanccntttgagaggctggggcgggcggttcccctggggttagnanctngaaacccncctgggcaacntggcaaanccccnnccntcctaaattccaaaatttacctggttttgttggcgnncccctgtattccccnctcnttgaaaggnngggacgggaaaatccnttgaccccgggnggcagaggttncnnnggccccanattgccccntttccntccagccngggcgacggancna

SEQ ID NO: 22803 - DNA, 673 bp, Homo sapiens
  misc_feature 127, 286, 495, 499, 501, 549, 560, 563, 571, 573, 576, 583,586, 605, 610, 626, 627, 628, 659, 672: n = A,T,C or G
tcagggaacacaattttaccttaaggttcatatccacagcacatcacagaatcaaaattaagactgggctcatatttgctaatctggagattgtgcctgtctgcaggaggcatagtctttgcggtgngaggaaggctacagctcggtggaactgcctccccaagacccagaaccaccatgggtacttagtgtgtacatcttgattgtaaatgcccagggctactctagaggtaaggaaaagtggagacaataaaaccagcaaacatacatggaaagacaagatganacatttagaggttcattatagcaaaagaaaaatataaacaatttcctggagaacttctgtttttattccttatttcacgcctttgctaactaatttgctattatttttgacaatcttttattagtaatatttataataattagactccaatatcatgaagctgggaagataaatatttgatgacaaaaacaaatgcccttggcaaagcntacncncagattatatttaaataaacttcatgattggtcataaaatgtctttanaacctaaacangangaatgggngngcnttatggnaanaaatttctaataatccacnttttnaaactttttggtatgnnngcttcaaaaaaatttactacttttggcatgnaaaaaattggcang

SEQ ID NO: 22804 - DNA, 222 bp, Homo sapiens
  misc_feature 162, 163, 176, 177, 191, 192, 195, 198, 199, 201, 202, 203,205, 207, 211, 218, 219, 221: n = A,T,C or G
ggggaaaatgattgaaagttaaactgataatttcttgaattggcaacgtaggatgtcaaaactgattttataagtcagtatttgtacttttcatatttcttaattccttcttagaatgaaacttgtcataaatatattttatgttctttttttttttttttnnaaaaaaatttttnntttgccccccgggnnggnggnnannnantnattntgggttnntng

SEQ ID NO: 22805 - DNA, 580 bp, Homo sapiens
  misc_feature 1, 9, 262, 335, 350, 352, 406, 423, 438, 441, 460, 461, 464,475, 489, 510, 514, 520, 528, 534, 540, 542, 553, 554, 572,579: n = A,T,C or G
nacgacagnagggatcagttttcatttaactttccaggcttttaaaattacttttagtgctttctatggttattaaaagactacaagtacaaatatgcttcataacaaattacaaacacttgaaatatactgggattgtgtttattctctgtttagttacatagctgtattgaagtctctgtaaatgaaaaatttacccctatccctcaacatgtaggttgagaacagaaatattaatgggtgtgatttattaattcctganggctattagcccatcaatagactacttcaaataaccattagtctcaatagtattgattaattccccaaatgcntttaaagcattagtntntgaagtgcccttaagtgagcctcacgtttcctcattctacagataaaaaaccanggtcagaaaccacaagngactttttcccagtnccncaggatttaaggcagggcnngancccaacccagnttccctttttgaanaacccatttcctgggcccccntttnaaaaancccctttnaatttncctggnanccgggcccttnntttttaaaccaaattggnccttttng

SEQ ID NO: 22806 - DNA, 770 bp, Homo sapiens
  misc_feature 11, 15, 18, 30, 41, 43, 50, 59, 61, 64, 72, 77, 123, 151,158, 713, 729: n = A,T,C or G
ttttttccgtncganaanccttgcttgttncttttggccgnancggcctncggctgcgnanagnacgacagnagggnatacacatatttaataaatagtacactgtactatggaaggatgagnataaaatattatggaagcattagagagnaaagagnagaatttccaatctatgggtatcataggtggtttcttggaggaaagtggaactgaactaagcctcgaagttggtaaggaacagatggttggctatggtagggtggagaaaagcagagttgcagaattctcttatgttgtagtcccaaattaatagtaatgtactagattttcttctcctctcttgtgaatttccagcaacagcttgattttaacctccacagaaacacaaatgagagctgtgatggaaacaataattactagagtccagttttaactccaagtcaaaattttagtcacattcagccctgaataagaaataaggcaaagcatgcaacaggactttataactttttaattttaaggcattataaatataaatttttattttatcttatttttttagagatggggtcttgctctgttgcccagacaggagtgtagtggcaccttcttagcttactgcagccttgaactgttgggctcaagcgatccttctgcctcagcctgctgagtatgaggatgcaaaggcataagaatgacacaatggactttanggactcagggggaaanggtgtgagggataaaaaactccaattgtgtgcagtgtatac

SEQ ID NO: 22807 - DNA, 727 bp, Homo sapiens
  misc_feature 4, 12, 132, 648, 654: n = A,T,C or G
gacngtaggggnatggtagtgccccaggcactctggcacccagttttggaactgcagttttaaaagtcataaattgaatgaaaatgatagcaaaggtggaggtttttaaagagctatttataggtccctggnacagcatcttttttcaattaggcagcaacctttttgccctatgccgtaacctgtgtctgcaacttcctctaattgggaaatagttaagcagattcatagagctgaatgataaaattgtactacgagatgcactgggactcaacgtgaccttatcaagtgagatggagtcttgccctgtctccaaggctggagcccaatggtgtgatcttggctcactgcaacctccacctcccaggttcaaacgtttctcctgcctcagcctcccaagtaactgggattacaggtacccaccaccatgcccagctaattttttgtatttttagtagagatggggtttcaccatggtggccaggcttagtctcaaactcctggcctcatgtctgcctgccttggcctcccaaagtgctgaaattacaggtgtgagccactgtgcccggccaacatttcttaacctagtagtttagtttttatagtttttattaccgcagtgaacgctacccccaaaaatttcatttngaattnttaacctaaaaagaaatattttgttttaaacttttaaactgaattttcaataacattcacaatcatattaaat

SEQ ID NO: 22808 - DNA, 724 bp, Homo sapiens
  misc_feature 32, 185, 660, 708, 718: n = A,T,C or G
gacagtagggggtctctgtcgctggggctggnagtgcagtggtgagatcatagctccctgtagccttgatctcctaagctcaagcgatccacacacctcagcctcccaagtagctgagactacaggtacatgccaccatgcctgagccaccgcgcctggcccaaattcctatttatttatttatntatttgagatggacttttgctctgttgcccaggctggagtgcagtggcgtgatctcggcttactgcagcttccgcctcccaggtccaagcgattctcctgcctcagcctcccaagtagctgggattaaaggcacgtgccaccatgcccagctaaattttgtatttttagcagagacaggatttcaccatgttggcgaggctggtcttgaactcctgacctcaagtgatccacccggcagcctcacaaagtgctgggattacaggcgtgagctactgtgcctggccccaaaattttaatatatttaaagaagtctggtacattggacaaagtcttatagtttctcaaatcagaaaaagtagtcttattatttagtaaaaatgtgaccagactgtgccgtttttgttagtagagccatttgtcatctggattacttcttctggaaattgggatggaagagttacggttgaggttganatccacgttcttttgtttcaacaccagtttgattctcgtgtctgaacngatgtctcantctttt

SEQ ID NO: 22809 - DNA, 711 bp, Homo sapiens
  misc_feature 6: n = A,T,C or G
gggggnatggccggctgtgtggtgggaaggactgtgtatgtctgctagctgacaaaactgagcagattaacaaattttgactattctgctcccatgacaacactttatttagcgatatttcagtaccttgttaaaagcacagcagtcaccgactctgcaaggcagcacagtgacttcccagactccagtgagttccctgagtttgacagacacagattcactcaagcacgaacacaagaaatcgcagagtgcaagacaatgggtatctatttctaagaatgaatatggaacctgtttcatttttcaccttcaacttcttcaaggtgatttttgattaaatgaggaatgtccatattaagaagcaatgtcttgtttcctaagtctggtccttaagtcaaagtgctctaattagatcaattttagccattcattacattaatcagtatttattaagtttctcttttctttcttttttgtttttttcagacagggtcttgctctgtcacctaggccagagtgcagtggcatgatcacggctcattgtagcctcgactttctgagctcaagcagtcctcccacctcagcctactgagcagctgtgaccacaagcatgcaccaccatgtctggctaattttttttattttttatttttgtagagatgaggtcttgctgtaatgcccaggttgggtcttctgggctcaagtgatcct

SEQ ID NO: 22810 - DNA, 543 bp, Homo sapiens
  misc_feature 17, 496, 541: n = A,T,C or G
gggacaaaaaaatgcanaaaagtgattagaaagataactgtttaaagtaatcattccaaaatgtttaaccgttttcagcgggtaaggaaagagaatcaagaacagtttctattgtctaatgttgtatttctaaatattctgtaatcatacattacttttttaaatcagagaagttgttcatgattcagagagtaagagagatttataagtaagttccatttgaacctccttaagagatcacctttacactgattatgcaactggcctagaaaaatacttgaaatattcttatttaggatatataaacagttgtatttttctgtctcagagacaaagctcattcaattggcaaagccatatgtgaacggctgaaggattctcttcctaggcaactgtttgagatagcaattcaagctgctattggaagtaaaatcattgcaagagaaacgtgagttgaaattcattttttggtcttgagccagtttcagaaatgatntacccaaaaaaaaaaaaaaaaaaaaaaaagcgggccttttttctnat

SEQ ID NO: 22811 - DNA, 638 bp, Homo sapiens
  misc_feature 5, 138, 180, 580, 612, 627, 630, 631, 632: n = A,T,C or G
ggggnacattaccacatgggggacaccgtcacacagtcacacgaacacactggcatagtcacatggacggacacacagacatatggagaaatcacactgacacaccaccacactatcacagggacacagacacacggnagacgtcaccacatggacacactgtcacactaccacaggggnggggaggacatcacactgtcacatggacacaccatcacacacatgaacacactgacacactgccatatggacactgccacacacactgccacactgtcacatggacacacctccacaccatcacaccaccacacacactgccatgtggacacaaggacacacagacactgtcacacagatacacaaaacactgtcacacggagacatcaccatgcagatacaccaccacatggacatagcaccagacactctgccacacagatacaccaccacacagaaatgcggacacactgccacacagacaccaccacatcgttgccacactttcatgtgtcagctggcggtgtgggccccacgactctgggctctaatcgagaaattacttggacatatagtgaangcaaaattttttttttattttctgagacgtantgtcgctctgttgcnggnnnggggaa

SEQ ID NO: 22812 - DNA, 735 bp, Homo sapiens
  misc_feature 4, 533, 539, 624, 628, 643, 689, 704, 730: n = A,T,C or G
gggnattatcttgatcacctttgcaaattcagtgccaagcatgaagctgggtacacattcaaaaaaagtgtgttcaaagaatgccttttaaagtagctgtaagactatgtggcatgctggtccttgatgatatagggcagacagtgtaaacatggccttacctcctaatgcttatgacctgatgaaaataagttagacattttataatggaaattataaatttatttactcatattcatttcctgaggctctgtacatatttggtacaatgggggtatttaaaaagacaagtgtctgtcctttagcattccaaagagttagaggacaaaactgtaaaattctggtatgtaatatttatttcttataaataaatacatatatacacatagcagtcatgtgccgcataacgatgattcagttagtgacagaccccatataggacagggtcccatatgattataatggagtatatttgagccaggcacgatggctcattcctataatcccagttacttggcaggcagaggtgggangattgntcaagaccagcctgggcaacattgtgagaccctgtctctaaacaaaaaaaaacccaaaaacaaacaaaaaaaccttctgtcttgnccancttctagtcttcaangtttttcctgatctcaaaacaaggactgcagactaatgggggcctnagccttgctttggancctggacactctaatggctgttgtanggctt

SEQ ID NO: 22813 - DNA, 719 bp, Homo sapiens
  misc_feature 13, 573, 709, 716, 717: n = A,T,C or G
ggggaggcggggnatgctgcggctccgcagcgggctgaggcaccttcgggcaacacccaatactcggggctccgctcggcttctttgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagggtggtaaatctcgtgaaaaggtggtgaagcttttggcttctacaactccagaagagatcttggagaaattaaaaaaggaagccaaaaaaacataaaagcaagaaatgaggccgggcgcagtggctcatgcctgtaatcccagcactttgggaggccgtggtgggcggatcacctgaggtcaggagttcgagancagcctgaccacatggtgaaaccccatctctacgaaaatacaaattagccagatgtgatggcgcatgcctgtattccagttactcaggaggctgaggcaggagaatcactttgaacctggggggcggaggttgcantaacccnnat

SEQ ID NO: 22814 - DNA, 98 bp, Homo sapiens
  misc_feature 55, 59, 61, 62, 67, 69, 77, 78, 83, 84, 87, 89, 92, 93, 96: n = A,T,C or G
ttgaggcccttagacatttttaaaaaagtttactaggctgggtgtggtggctccncctntnntcccncnctttgggnngctgnngtngntgnntcntg

SEQ ID NO: 22815 - DNA, 805 bp, Homo sapiens
  misc_feature 4, 7, 9, 10, 11, 13, 20, 32, 33, 42, 43, 53, 67, 68, 87,89, 116, 252, 253, 255, 412, 414, 435, 437, 686, 758, 799: n = A,T,C or G
aggnagnannngnttttgtnttttaaaaagtnntattggttnnataaaccagnttttttgcttttgnngacagtaagggcagctcangnagaggggggggaaagagtggtgggganagaaggaagaggctggaacttgattaaaggttaggaatcagtgcacacaatggaaggttataagaattgggcctggttttctttctgagaagtttgtaggaagatgtgatcagtctttaacactataaagcttatnngnggaaggacagagaagagggagggaggggaggaaggaaaaaaaggaaaagaaaactgtgaagataagaaagtggaattaaggtttcctaaagaaacaacaacaaaagcctttggtgtctcactttcaccaggtgaggagtgatgctcaactccactgnancccagcagacaagacagggantngaacgactatgtgaaggatgtctcagttgggtaggcaatgcactgggctgaaggccatccttatttgctaggtgtctgaaccaacccctctttccacatccttggatccagtgtcatcctttcttgcttttttgtgattgctagtgtctgattctttgatctagttgttaatagatagtggtagtatgatgctcctctatttgtataatcttcctgctgtttttccctctgccctgttctggttggcantactacatgaagaggacagataggcatagcttcactatgttacactgcaaatcacgagagaacatggaccantgacttctgccttaaaaggcatcatccttgtcctacatagnacctct

SEQ ID NO: 22816 - DNA, 235 bp, Homo sapiens
  misc_feature 106, 111, 169, 171, 180, 217: n = A,T,C or G
ggggaggggaaacataagcaaaaaataatttcagatgagtactgtgatgaaaatgaaactaaaaggatggagagtgacaagactgtatgtaagggtggtagcgtantttanattgaatgcttgggtttactttctggggaggtaatagttacactgtgacaaaatgaananatattggtntgtgtgtggatctctgggaagagcttttcaaggaganagaacagaaatgaaaaaa

SEQ ID NO: 22817 - DNA, 689 bp, Homo sapiens
  misc_feature 5, 8, 10, 14, 20: n = A,T,C or G
ggggnagnanaggnagtagnagcattatgtggaggtacttcccggttcccttgcgtctgagggtcttatgccagaggggatagaaagcccaacagaaactcaagatagaagaaggagaatctgcgagtgtctgtctcctgtcaagcttccctaatacagccctggtagaacttcatcaacagtggaaggcatttgcaaaggtgagcccaaaccagcacccctttccacacaggctgtccatgtagaaggcccagatgcttctcagggtctctgagaggatacaaagctactgagggggccagagggcacagcacctgggatttggatgagaagctgcaggaagggaactttgcaccccaagggcatggtgtggagtcaatagtgcaagttcagtctggttttttacatcagccggttcagaggaagagtgaaatccccaagatcagcagggcaaaatgctggaagttgtcgaggatgcagagagtagcaggaagacacctctgagaactcactcacacaccctgcccctgtgtagagatgtcatcctggggatgagaaggaggaagacagagaaacgcagaaaagcctaagcaggcaccacaaagagaccgagcccgtctgaaagaggctgctctaacctggtggaaactattttaagttgccaccagacattacattccagagccttg

SEQ ID NO: 22818 - DNA, 753 bp, Homo sapiens
  misc_feature 1, 17, 19, 22, 49, 226, 230, 696, 719: n = A,T,C or G
ntggcctacggctgcgngnagnacgacagtaggggattttcaacccctntttatggttaatacagcgtatttagtggaaaagcatgtaagacacaggttaaaaactattagaaagggttaagaagttcaatactgagtcataaagtaaactaaaattaaagttcaaacttcataaaatatgaaatccctttagctaacataagatcatgtaaccaaaaacattacntatntttataacatcagtcaatataataaaagatgaatcctactaaaacttttatgttgcccagtccaaataattgtttttctacctaactgatttgtgttcatactgatccctatatcccaataagtatacattaatcttattaatttaatatttatgacttgagtgactgctatccatctagaacacacagattaaaagaaagaactataccttccatatctatccagtgcatttaaatttgcttttttcttgattaaaaatttcaccacttgctgtttttgctcatgtacaccaagtaacagtggtgtgaggccatgctgtaaaacaatataaagcaaaaaagtacatattcctcaaccgaagtggaaactttatataagatcttatggacttacatgcatagaaagtaaataaaatgtagtcgcttccttctcactcttctgtgctttcccacacgctgctccttnccttggaacacccccttctctgnctcaccacagtaactctactcatctcaaaaactc

SEQ ID NO: 22819 - DNA, 655 bp, Homo sapiens
  misc_feature 4, 7, 518, 643: n = A,T,C or G
aggnagnatggacctccctggcagccgagtctgtggagtgaagggagggaagttaaaaacattcgagatgaaagaatgtgaggaagtttgcagttcagatggacctccgtggcatctgagtctgtggagtgaagggagggcacgcttggaggcggggccttcaggccttcctgcgcttgtgtctgtgagataaaggcctgaactaaggtaacagggaaggagaaaatgaaactgaaggaggtaaactggaatttggagactgacgaggagagaaaggaaagcattccagggaaaccccagttttttgcttggctactttgggtaggtgatggtgtcattaaccagaatcaaaaatgtcagtggtagattagatttgagtggggaaataaaaagttctctttgagatacaccaaatttgaggtacttgtggatttcccagaggcatcctacataggcacttaggaagagagccaggggattcagggtgattgtgtaggtagcaggtagccaaggcgtanaggagactacaaggaaaaagttgtgtgaagagagacaagaacctaggacagaaagcctgagaacaaaatatcttgtgggctggggaaggggaactggctaagtgtactggaagggaatggcctanaagtccatacac

SEQ ID NO: 22820 - DNA, 726 bp, Homo sapiens
  misc_feature 4, 460, 466, 485, 494, 516, 540, 561, 573, 590, 601, 620,626, 696, 699, 721: n = A,T,C or G
gggnattcttaataatatatgattcaaaggaaataggtaatagattcttaaaccaccatcaattttttattctgacctgtcattcaaaaaaatatattttgagcccaaatataagggaaggactagattttgagcaagatcccaatttacggctgggagcggtagctcacacctgtaatcccagcattttgggaggcctaggctagaggatggcttgagctcaggagttcgagaccaggctgggcaacatagtgagaccttgcctctactaaaagtttaaaaaattcaccgggcatagaggtgcacacctgtagtcccagctactcaggaggctgaggcgagaggatctcttgggcctgggaggttgaggctgcaatgagctatgattgtgcaatgagccactgcactccagcctgggtgacagagcaagaccctgtctcaaaaaaaaaaaggtcctgtntgggcncagtacctcatgcctgtantcccagcantttgggaggccgaggcggccanatcacctgaggttaagagtttganaccagcctggccgacatgganaaaccccgtctntgctaaaaatacaaatntagctgggtgngggtagtgcatgcctgtanccccanctacttaggaggctgaggcaggaaaattgtttgaacccggaggccaaaattgcagtgagctgaaatcacnccnctacctctaccctgggtgacanagctc

SEQ ID NO: 22821 - DNA, 695 bp, Homo sapiens
  misc_feature 23, 614: n = A,T,C or G
gggaggagaaggccatatccagnaataatacaggttttgtgacttgagtagtgctcagttgagattgtgaagtgagcacagtccttttaatcttaacgcaaatcagcttcagggacttggaattaacagaagatgagtcttcccagtgaagtgagaaatactagaactgttctgactgagcatgaaggtggaacatggttgggcatggtggctcacgcctgtaatcccagcactttgggaggccaaggctggtgggtcacttgaggtcaggagttcaagaccagcctggccaacgtggtgaaaccgtgtctctactaaaaatacaaaaattggccgggcatggtggcacatgcctgtagtcccagctacttgggaggctgaagcaggagaattgcttgaacctgggaggtggaggttgcagtgagccgagatgacggcattgcatctgggcgacagagcaagactccatctcaaaaacaaacaaacaaacaaaaaaaaacgtggaacatcaagtggaggtagggcggggtacttagactttggactctggtataagcactgataagaagccatagaaaggccgggctcacgcctgtaatcccagcactttgganggccgcggcgggtggatcacgaggtcaggagatcgagaccatcctggctagcacggtgaaaccccgtctctactaaaatac

SEQ ID NO: 22822 - DNA, 637 bp, Homo sapiens
agggatcattcaataattaatatctatcattttccattaactaatttattttatgaccatttattattattattaccctatggtagtcaataattactgatacatattccattgttttttggcatttgatatagaatcagagaagtttgttgccaactcctttttagttgaatatatattgtttttgtcttatatttagtttttgtaaaacttcagattttccatcttgccccactatttattgctaaaaatcatatccaaatatgacaaggtttaggaacacacacagttaatgaacacatgttaaagtataataacacagaatacatttttgaaagtaagtttattaaaattagcaatatatttctagttatatgcataaggatataccaacatggattttgcctgcccaatattaattttctcttaatttcttacttacagaacttcaatttggtcatgagtctaagccccaaattatgtttgctgtcatgtactcatgacagctctttttcttgatttttctagcctttatccatttgggaaatgtgaaccaccttttataggtgagatacagtatagctgaacacttctctaaaggtttctgtaaaagcataaatgtacaagcctatcatcc

SEQ ID NO: 22823 - DNA, 298 bp, Homo sapiens
  misc_feature 124, 142, 155, 178, 183, 194, 226, 229, 233, 279, 280, 281,286, 290, 292, 293, 294, 295: n = A,T,C or G
ggggacacgcctcttattgagaatggcaaagtagtatctatcatagcagaattgctctctactaagacagatatggttgagaaagcccttctttaccggactgtggccacaggccgtgacatcnttgacaagcagcacacanaacaagaggccanctacggcagaaacgcctttgccnaggcnattttgagccnctttttttgttgatctttctccatcaatgatnttnttgngtcagactttgcacccatcctgggaaaaaaaaaaaaaaaaaaaaannncgccntttncnnnnaca

SEQ ID NO: 22824 - DNA, 725 bp, Homo sapiens
  misc_feature 1, 9, 580, 585, 616, 663, 679, 707: n = A,T,C or G
nacgacagnagggggtggtttagtaaaaatgggaaatatggatactttagggaaaaaatgtttagttatgttgttgccattccaacttagatttcatacctgagtcttcaaaataatttatagaaaaagtgactatgacttaaacgaaataaaaagtgaggaaagaaccatttattagattttatcttaaactctcactttatagtttgttccagaaatagtttctacacaagtagatagtcattaacatagtcaatatgtattttttgtcagattagtaagagcaaatttaactctggttctcttatattttaataattggtaatttatgagtgtatgttaatcctattaaattatgtgataaaagtattcaaatgacatatattttcgtgagttctgatgcactgtgttaaatacacaaaattaggctgggagcggtggctcacgcctgtaattccagcactttgggagtctgaggcgggcggatctcgaggtcaggagatcgagaatcacgaggtcaggagatcgagaccatcctggctaacacagtgaaaccccgtctctactaaaaatacaaaanattancctggcttggtggcggcacctgtagtcccanctactcaaaagctgaagcaggagaatggcatcaacccaggaggcggncttgcagtgagcgganatgcaccactgcctttcacccgggcganagggcgagactccgtctc

SEQ ID NO: 22825 - DNA, 710 bp, Homo sapiens
  misc_feature 51, 690: n = A,T,C or G
gggactcgttctttaacatcttctagtagaggcgctaacaagtcacaaagnaggtccaaaggtgaacagggaaaaggaatttagaaattagtttttcaataactagataaataaatgatgaaatgcatattttaaatttacttgcaaactgacaaagatattagtcttcctaaaatttgtttatgagcctacttcttcaacataagcctaaaagaggcctggctttgtgcttttcccccttagtatcactttcaacattgtgcttttgaatgaggttactgacaagtatatgaagaagcccatgggcattgggtctgtattgctacatgtctttattattttggcaccttataactgagatttttgtattatgcactgctgcacagttggatttgtaacaaaggataaggaaggactataaactttgataccagatgaaatcctgagaaaactttagcattgtaactttttattacaattgtataatttttataattttctaagggcagagattattgcccttattttgaagaattaggaaaaggaagggtatttcatggcatctttattttaacctttcttttccttcttctgtaaggaagttcatattgggctcatgtgttatctggaaaaaagttgtttatatagttctgcagaatcactaatctgactttcttgggcctttgaaangtgccttccttgagttttta

SEQ ID NO: 22826 - DNA, 730 bp, Homo sapiens
  misc_feature 1, 9, 24, 31, 32, 191, 349, 350, 693, 702: n = A,T,C or G
nacgacagnaggggtgaatctggntaagggnngaacttactcaaccagtggcacaagtggtgatgagaattaagaaggaaaacaaatataaagtgctggcatgcgacaagctctcaatgacatttgtgggagagaagtcaaagctagaatgactttctcttttgaagtatagctaatcaatatagttattncaatgtggaatcattttcttatgagagcgtgtgcgaagttcaccaaggctcagttgcttatacctgaggaatgccttattaaccctagacttactaatacgctaacattatatcagtgatgatgagatatcattagagaaggcacattccaaggggcnncatacatcaatcgtcctaaaaggtccttgataaagaaataactaaatccctagtgacatatcttgcaaacacagtagttggaaactgtttcctaagtttcttatcttcaatgatattttaaaattaagaagtcaaagacttaagtactgtttgtgggagttctggaattagaagcccagacaggaacagtgtattgtggcactgacagcctggcctttcttatttattttacattattagcgtgttctctcaagcctacttgcataaatacacaattatatgtatttaatgaattcactcttaaacagctgtagaaaatgtgctttactaataggggggcatncagtcaganaagcagtcataacgcgttgcgcgccccg

SEQ ID NO: 22827 - DNA, 451 bp, Homo sapiens
  misc_feature 401: n = A,T,C or G
ggggccttctagaaacaggaaactacagtatttgagttgcttttctaagtaagctaaagcctttgcttgtcttactgtttaacctgacttgctatgatccctgatgtagagctttaagtgaaaacttaatggctaactagtgtggaggatgaccatgtacctgaaaatttcttcaccaaaaataaccatatgggccaggcacggtggctcacacctatcattccaacactttgggaggtcaaggtgggaagattgcttgagcctaggaatttgcgaccagcctgggaaacatggcaaaatcccatctccacaaaaaatacaaaaattagccgggtgtggtggcacatgcctgtagtcccagctactcagaaggctgaggtgggaggatcacctaagcccanggaggtcagggcttgtggtgagccattaccctgccagtgcactccagact

SEQ ID NO: 22828 - DNA, 430 bp, Homo sapiens
  misc_feature 395, 396, 408, 409, 410, 411, 417, 418, 419, 420, 421, 422,423, 424, 426, 427, 428, 429: n = A,T,C or G
gggccagggccaacattttcccctaaacaagccaatcaacaaaaagcaatgccaaacaagcccctttgaaactttcaaagtcctcatcctagtaccttcctagcactctaggagacatctttcagctgttgatttatgaacgctgagaggcacgtggaggaattaatggaggtaaatatctaacttaaaaaatcttcagtaggcattttttagacaatcctccttgaaagaaaagtgtggatgctctgtgcgtgtattgactgcacctgcaggggtatagctggagaacacccagtgagcatcttcaggagccaagtcacgcaggggcttagctctcagtccattgcgacagttgccatgatgccttctgaccattaaacactttgaactcttannaaaaaaaaaaannnnaaaaannnnnnnnannnna

SEQ ID NO: 22829 - DNA, 775 bp, Homo sapiens
  misc_feature 478, 551, 568, 576, 587, 589, 624, 626, 654, 663, 683, 695,698, 718, 737, 748, 750, 772: n = A,T,C or G
gggggaaaagccagtcagtgaagcagttagagaatacacattattcattgattaagttcgccgtcctatatgggcatggtttgtggcataccaaaacaattacaacagtagcatctgagatcactgatcacatatcaccctaacaaatataataacaatgaaaaattttaaatattataagaattaccaaaatgtgacagagacatgaaatgagcacacattgttggaaaaatggtgctgatagacttgctcaaccagggttgccacaaacctgtgatgtgtaacaaaacacagtatccgcaaagtgcaataaagcaaagtgcaataaaacagataagggctggaggctctggagttgaaagccctctacatggagatgatcattgaagacatgtgatgtatgcagtcactaagagagaagctgtagaagaaaaagctgagtgttggagaatgttgcctatggggtatgaagatgaangggagctggtgactgagactgggtaggagcagtcagagaggtaggagacagaacaggagggggtggagtgaangaaaggaaaaaaagtanggcttaanaaagacttggncnttctttacccaacaaggcagacaaattcagagcananacctgggaagtgatgagtgggttcttantgaccatantgagaagggtcatggcttgngaggcagagctnttntgggctcaggaaaatggaanaaacatggtttttaagggngctttccttancnatggcataaaggaggaaacttnaag

SEQ ID NO: 22830 - DNA, 711 bp, Homo sapiens
  misc_feature 642, 679: n = A,T,C or G
gggagctttattcagattattctaagtctggcatgaactaaatgtcttaaattgttatcctaacaattggtaacctcaaattgatctgtagatatatgtgatgatcttttagataagagtacctaagaatgggtcagacacagtggctcatgcctataattccaacactttgggaggctgaggattgcttgagcccaggagttcaagaccagtctgggcacaatgacaagaccccatctctgcaaaaaattacaaaattagccaggcatggtggcgcacatctgtacacccagctactcaggaggctgaggcagaaggatcccttgagcccaggaatttgaggcaacagtaagctatgattgcaccactgcaatctggcctgggctataaagcaagactctgtctcttaatttttttaaaaaaaggtacctggcccaggcatggtggctcatgcctgtaatcccagcactttgggaggccgaggtgggcagatcacaagttcaggagtttgagaccagcctgagcaacatggtgaaaccccatctctactaaaaatacaaaaattagctgggtgtggtggcgtgtgcctgtaatctcagctactttgggaggttgaggcagaattgtctgaacctgggaggnggagggtttagtgagccgagatcgtgccactgcactncagcctgggtgacagacgagactccgtctagg

SEQ ID NO: 22831 - DNA, 691 bp, Homo sapiens
  misc_feature 4, 662, 667: n = A,T,C or G
gggnatcaccaggtgttcaggatgagccccaaatggttctttaccctgaagaaatgtaccttatgaaggacaaaattataaactgtgtctaagaattgctctagttaacatattaccatgggaatatattttaactgtaactatacctgacatagtaagtatataatgaaaatctacattaatgtggttggattccaagactgttccagaaaaagttgtccttaatctggaatgcacttgaagtaagagaatacaacaggttggttagcttccgaggctagcacacaatattctacctaatctctgctctggtggaggtatggcaacagtaaaagtggtagtctggagccaaggctagccccttaaaaagttttctgtatccttagtcttcctgcgtattgatatggttatgaataagtttctagtcttatctacaagcctaattaacctgctatatataagaaatatgaacagtattcctttcactagacataaatatgtgctttacacttaattttaaagaaatgtcttctgtatttctatatagtatgctagaaaagtgcacacatacatgagtgtgtacacacactcacttacaccattaccattgctctgaaggcatcagcacccataggcactcaagggcatggctaagggcttgntgcanattgtattgaatgcatggattatc

SEQ ID NO: 22832 - DNA, 772 bp, Homo sapiens
  misc_feature 663, 666, 695, 712, 714, 724, 728, 748, 757: n = A,T,C or G
gaaggtgcaaggagcaagaacagagtttcccctagagcctccagaacagaacgtggtcttgctagcaccttggttttcatgcattttaaacttttagcggtcaaactctaagatcatatatctgtgttgttttcagccactaagtttgaggtgatttgttaagcggagacgaaagccaacacacacacacacacactcacacacttgaactaaagtggatagacaagatatttcagatactactttaaaaggccctaaagccaagactaatgtgtgaccacaattacctggaggatttaagaacctaatgcttctgcgggtggcacgtttgcccaggtatttgtactaatcctctgctttgctgtagcttgatttcctggcttaagtaagcaataggtttattgctctgtgccctgtgggcattccataaatacttgttgactgcctgacacagtaagtgttgtaattatctctcagatgggggaacaggtgtggtgaggttaaagcggccaggtaagacaagggacttctctggggttgcatagcaaccgggaggatgctgagctgacatcaagttgtctttgcctataattgtctgccctttcataaccacagcattcactttcacgttatccatctttttgctcatttcagttaggctgnganggaccagtattggttcaagccccaagatnctgagtaaaatcctggncntcacatatangaanatttgaattctgaggctgangtgatttgncctattatgagcctc

SEQ ID NO: 22833 - DNA, 545 bp, Homo sapiens
  misc_feature 446, 501, 506, 513, 514, 515, 517, 529, 535, 536: n = A,T,C or G
ggggttgaatagttttaagttttccttcttttattatggtgtatgagattattctcaaatgaaaggtatgtgtccaaagagcaaagttctatctcctccatctctccccaaaaaaacttacgtcatttcaacccagatcttttgagggtttaatcttccttttagcttgcatagacaggaagtgtttaaaattatttagcaggccacttctccaaaagctttggctgttttttactttatccttatcgtacctgacaatttttgctggatgcttttgattgtgctaagatattagttgtctttcctctttctttatcatcaatgtaagaattgaggtaatatttgaccactgtctcaccaataggactgtgcattgggcagatattggaaaatagtaaaagacattttcatgttaatgttttaaaatcatgatctgtttcccagtnttcagtttaaattcagtttgtttgtaaggaaaaaaaaaaaaaaaaaaaaaaaaancgccntttttcnnnancccacttaaaancttgtnntgccccccc

SEQ ID NO: 22834 - DNA, 728 bp, Homo sapiens
  misc_feature 29, 169, 219, 448, 493, 531, 576, 583, 589, 600, 601, 611,613, 625, 632, 641, 654, 666, 681, 694, 703, 707, 714, 721,725: n = A,T,C or G
gtgtcatttcttgattggcgtttgacaanggcttgtattgtttgcttgctgacagtccagggtactggccaggggtcacttttacttagggaatggaccttgctgctccctagccttattcaaaatggcacctaaaatatgtgtggtgtctccaattggctgtaggtgngtgattcgttgaccatccctgtttattctgttacagttcctttattgaanattcagcatttacaaagcatgatacgaatcaagagtattgtttgatctcaaggtggattcttgatggtctagaatcttgaatcgaattcttaatgattgcccaacccctttctaaagccataacaacagtagaatggctcttgaaatattctaatacttaaacacaccagtagattcacacacataaaacaaaacccctctgtttcctcaaaatgccagcgctgaccanagtttcttttttaaaatttgagctttatcttaaatatttaatcanatcttttcctcatcccccaaatgaaggaactcaagtanatttctaaggtcccttccttttgacctctcatattgagaatctgnattttanggtcancaaaaactctnnttaaatgaananaccttttaagtnctttttntaaaattantaaaaaataagtntttatctgaccncggggctccccctgnatcccaccttttnggaagctcnaggnggcgatnctgaggncagnatt

SEQ ID NO: 22835 - DNA, 769 bp, Homo sapiens
  misc_feature 1, 651, 654, 670, 691, 709, 729, 739, 741: n = A,T,C or G
nacgacagagggaaccacttcttttctcccataggtaaccactgtttgttataatcacttcctggattttctttatagttttaccatctcaatacatgggatcatataccatctacattttggtgtctggcttctttgttggacattaagtttttaagatttatccatgttgtagggaactgtaatttgttcattttctttgaagtagtattccatttataactatagcacatttatctatttcactgttggtgaacattttaatataatggtttttttaagctccagactccaggagatgcctgtttcttttttcattctcagacattgttactttcgttcagttgaagatgtcacacatacctattcccttgtgtagagtgaaaactaatttctccctaattctttctagaatgataaatactatcatttttctcctccgtctgttatatagccacttcttacaatgttgatttctattgttcagttgaactcaaaagaaacttgggaccaggcgcggtggctcacacctgtaatcccagcactttgggaggccaaggctggtggatcacctgagtcaggagttcgagaccagcctggccacatggtgaaaccctgtctctactaaaaaacaaaattaaccaggttggnggnggcgcctgcgatccanctctcggaggggaggcaaganatccttgacctggaggcnaggttcatgagctgaaaggnccctgcctcntntggaagcaagcagatcctctaaaaaaat

SEQ ID NO: 22836 - DNA, 813 bp, Homo sapiens
  misc_feature 3, 12, 16, 19, 28, 31, 42, 44, 51, 62, 65, 72, 768, 771, 812: n = A,T,C or G
ttnttttgggtncganaanccttgcttnttncttttggccgnancggcctncggctgcgagnagncgacagnaggggaaaaatggaattttaggcttcggtgataatgactagtatgaattgtgatagtttgcatctccaaagtaaggtcttggctggagttattagtatacatatagaaaccatagaagtagttgaagggctcaggtatggtttatagatgggaagaggactagaaatagaaaacaccaatatttaaggtttatttacagaaaataaacttacaaaggagacagtacaagataggagaagaactagatcagagtggtgttatggagccagagggacagggttcaagcagaagaggatccatttgtttcatcttttttactatgatgctaagatttgaatagttccttttccactaaatgactcaataaatggacggatataaatatgataagaattaaaaggcttccactggatttttcagttagaaagtgaccttagcaagagcaatggtatttagtggacacacaagctagatatatatcactgttgagtaaacaggaaatgaggatatggagacagcacgagtgattgattaatggggttattgatcaggaaaagtatggacggaagaaattgtggtgggaaaatttttaataaataataatctctcccagtataccgtcacccactttcataaatattaattcataaactggttctgtagacttcaactgtttattatatattctattatttntcntaatattcagttattttaatcattatcccacatatcttgtnc

SEQ ID NO: 22837 - DNA, 714 bp, Homo sapiens
  misc_feature 586, 618, 624, 629, 654, 670, 687: n = A,T,C or G
gggacacggcattttgttttcatcagtctttattcctgagtaccaccagcaaggcaaagcattgctcataaataatactgactgagacagaaagaaaaaatgtaagattgaaaaagcctgggccggacgcggtggctcacgcctgtaatcccaacactttgggaggccgaggtgggtggatcacaaggtcaggagttcgagaccagtctggccaacatggtgaagccctgtctctactaaaaatataaaaattagccaagcgtggtggtgggtgcctgtaatcccagctactcgggaggctgaggcaggaaaatcacttgaacctgggaggcagaggttgcagtgagccgagatcacaccactgcactccagcctgggcaacagagcgagactccgtctcaaaaataaaaaaaagaaaaagcctgtctgggcatggtacctcatgactgtaatctcagcttttggggaggccaagtaaggaagatctcttgaggccagaagtttaagaccagtctgggcaacccgttttgtagagtgacaccacatctcgacaaaaaaaatttttttttagttaggtgggtgtggngtcatgtacctgtagtcccaggtacatgggangctgangcaanaggattgcttgagtccaggaattcnaggctgtagtgagctntatgatccaccactgcnttccagcccgacgacagagctaggcct

SEQ ID NO: 22838 - DNA, 677 bp, Homo sapiens
  misc_feature 668: n = A,T,C or G
agggttcttgagtttacttggccctctcttggcaaaggctctttgtattttcctacactaaaggtctggccaagtaggggttcagattctcttcaagtatagaaactccccccgatttttatgtttgctggccttccaagtaagatttccattgaagaaaatgctccatggctaaaaagctttaaaatccattggtattatcggcagatttggactctatagagcctagtttctaaagtgcttcatagtgccgatctgaaagtgagatagcactagtcctatcagaggattgttcaacctgagactctgcatcagaaggtcaggcagcactgacctgtgtcaggcctggagcaggctctaggaggctgctttcgtgatgagttcctttttgttcaggagaatataaggaagctggtcctattttagaagcaataacagcctttgagtttgctctagggcaattgcaaaatcaagagcccccagggtgctgtactccagatttctaggtcacagatatccagaccagagttgaccagaaattggccagaatgggttctggggatgtggatgaattaccatttctcatccattcctactccatctccattttatcattctccattcctactccctcaataccaaaattaaaacaaattgttgattactangtagccttc

SEQ ID NO: 22839 - DNA, 780 bp, Homo sapiens
  misc_feature 1, 9, 621, 669, 697, 737, 755, 756, 770: n = A,T,C or G
nacgacagnaagggattttacatctataagtgaaaccttgttatccccttcatttgaggaaatccaaggagttttaaacagctctactttactggctatctctatacttaagccactagttggtttttggtttgtttgtttttagcatttaatattagtgtgtgttttcccataacttaattaccaaattaataaaagggtcattcttcactaagtatcacagtagtagtgagtgaagatagtcattctacccaaacagcctttgttcgataaggttaagtgcagtaaccagaagttggaagtatagaagatgtgctttgaaaatgcatgctagaagacttcggtcacagtgacatgacagaggattgttggaaaataacatttgaagtcaaactttcctgaaagcccaggcatgaggcaaggctttctggacaaaagtttccagcagaccacagtctgacacaccatcatgaacaagatcagattttaagcctccaagccaatcaagaaattaccttgaaatgtgcgcagtgtattttaagtaaaaccagtctctgtaggcactcaatatatgtttgtttaatgtaattaaatttgaattaaattcagtaaggctggttnctaatataaatatgaaaagcttattgaatttcaaatattttatggctntttaagcattactaacttgatataaagnggacaggactgtattattataggctgccttctatggggcnttgcatactttctggcannatggggatcttganccctgatatc

SEQ ID NO: 22840 - DNA, 671 bp, Homo sapiens
  misc_feature 4, 658: n = A,T,C or G
gggnaataaatcgagtcttttgttcagaaagcatttcccaaagcgacaggccattagatcatgtagcgcccaggaaatagatacttgcgttacaagctatgttgaagtcctgcacgccccggcttggatgtacaatgaggagtctgtgtgcccggctgcctggccagcccagcccgagcctcctaccttctgaaaatacacttgctggacatagcagagaaagctggtacatctccagcccttcagggcttcttgggacacactgttctggggaaaaccctttcatcaaaaggcatgtggggggctcacaaggaggtgaaggagtgaataggatgtgcctggcctttaatgacccaatcttagggtgaagagtggccctacagagttgtcactctgtaaaatgaatgcattgtgatctccagtcctgaaactgaaccctctggtctcaaaacacttccattccctgagtcctaatgacagtgctcagccagaggcagctctcttcatcttacaaagtagtaaagcacctgtctcaacagacagctataccccaagcctctcatggtcccttagcagtaaggctatggcctcatttttgtcccttctctggtgactcttcagaaaaggctgggggtgttaaaggtacagaccaaggccnggcatggtggctt

SEQ ID NO: 22841 - DNA, 759 bp, Homo sapiens
  misc_feature 1, 8, 18, 21, 29, 695, 707, 712, 743, 752, 753, 754, 755,756, 757, 758: n = A,T,C or G
ncggcctncggctgcganagnacgacagnagggggtcaattaaaatgccactgttatctaaactgtttgtttcatttgattagcacttatgcgcttctcaacactgagaagacatattcagtgctaaccttaagtattttacattgactttcaaggcacaggcaatgaggggagaaaagttgaggcttgttacaagtggtcatatatgagctcttcataaatttaatgtaagtcaggaatactttaagtctcaaatatcatcagaatgtggcagcagtgggtgagtagtgtattagaaagggcacagcctggggtcaagtggactctgcctgggtggcttggggtaggtttaacctcacagcttttttaatctattaaacaaggttttggtatctattttatagggtagtgatgaggattaaacgagatgatgtatataaattgtttagcacctagtaaatgctcaataaataatgcagctaatattagttattattttatagtaacaacagcaaatataataatagacaccagatatgaatctgacaagaccaaaaagaaatgataaagaaatgactaagataaggaaaatgattttattgattttagtgtggctcagatatctttgaatgttccctttactctcaaataaggagattcaagtagcacaaaaaaaaaaaaaaaaaaaaaccctnggggccgttttntccgnaatcccaactgaaaaacctttggggagttgnacccccccnnnnnnnc

SEQ ID NO: 22842 - DNA, 754 bp, Homo sapiens
  misc_feature 1, 18, 21, 29: n = A,T,C or G
ncggccttcggctgcggnagnacgacagnagggagaatgtgtcattttatccccattttacagcaaaagaaactaaacccaaagtcgcatagctaataaagtgaaattgagattgacaccaaacctaaaagtcaagtctgatgaagtacgattgatcttgatttatttagcctatagatatttagcttggggaagagaactttttgagtatttgaaggactctaataaggattattacttatataactaactgttcatcgctagactaataggtgtaaattagaggcaggcaaattttgttttagtagaaggaagaattttttaatagagctgtttttggatgatatgcactaccctaaaaaaattgttggaaataaccttcaaaagactgctgaatgctcctgtggcaggcgatgttacaaagaagtaaaaaagttgaattgggtgaattctgagtgttcttttaattctgttgcactctatgtgggagcataagaaaccttcaagacaggctgggcatggtggctcatgcctgtaatcctagcactttgagaggccgaggcggacagatcacttgaggtcaggagttcagaactagcctggtcaacatggtgaaaccctgtctctgctaaaatacaaaaatattggctgggcatggtggtgggcgcctgtggtcccacctgcttgggaggctgagggaggagaattgcttgaatccgggaggcaaaggtgcatgagctgaaacacccattat

SEQ ID NO: 22843 - DNA, 583 bp, Homo sapiens
  misc_feature 543, 557: n = A,T,C or G
gggatcacaaacagtctagggaatttccaagctctttaagagggaaagaatagttgtctcatccaagacgtttgcttacatgatttgcttaattttatagttggaagtagagatgttttacttaaaatggagaatggcagtgtttaagtgggaatctccgcctaacagttgaaatttcggacctgaaggcttagaaaatatttctggggaaactaacgtgaaaacattaaaattctaagcaaaataaagtagataacattctataatttgtcttcatgtggtaggtacagtaggatatggaaaaagcatgctattttagacgtatgggcactcttcttccacactgcaggtaaagggcaaataaccatcgttggccaagctcgatggctcacgcctgtaatcccagcactttgggaggccgaagcaggtggatcacctgaggtcaggagttcaagaccagcctggccaacatggcgaaaccctgtccctactaaaaataaaaaaatagctgggcttggtggcaggtccctctaatcccagccncttgggaggcttangctggagaatcgcttgagcctgggag

SEQ ID NO: 22844 - DNA, 670 bp, Homo sapiens
  misc_feature 550, 555, 606, 615, 662, 664, 667: n = A,T,C or G
ggggttaaagcaaataaggatggcaataacaactaatatttagtttaaggtacttttctatggggtgtgtgtgtgtgtgtgtgtgtgtgttttttactagcagtaggtactgggctctgtatggtatattagtaagagagttcaagcaaggcaagcagttgtacttgtgaacctattctcttaacccctgtgtgataatgctatcagagaacacatagactagaagggcttcagtcttagatgacattattaagctactgctcagacatccctggaatcagacctactcctagacttccaattatattatacgtcattgtttataataatactaagtaaagatttttgttaagtgagtataaaagtgtcttgactgagtcctcaaactgaccatcgggctgtctgataccgttgtagacctgattgaaaattcttgatctggccacataccctgtttacattgatgcagattcaactgggtgaaataactgtgaactgggcatgtgaagagaaagctgaaagccataatctcaagatggaaacttcagtntccancaaaggtatttataatcttgagacagacagaacactttctaccagtgcagngctctcccnacccaacaaatctagattttgcggaccaatcagtatactttcttaanangantct

SEQ ID NO: 22845 - DNA, 110 bp, Homo sapiens
gaagacaggagggggttttgcagcacgccaccgccgagaaaaaccgtgtgctattagccatggtcaaccccaccgtgttcttcgacattgccgtcgacggcgagcccttg

SEQ ID NO: 22846 - DNA, 380 bp, Homo sapiens
gggagatcactcatttaagaggacttagagttgtgtgaagtaatgttgtccctaattaatatgtatataattttacattgagtttctggccaaaggacctaactcctattttttaatgtagagaaaaactcctttagaaaatatttcaatgggcgttagaattttgttttgttttttaagacagaatctcgctctgtcacccaggttggagtgcagtggtgcaatcttggctcactagaacctctgcctcccaggctcaagtgatcctctggcctcggcctcccaaatacctgggattacaggcgcccaccaccatgcctgtctaatttttttgtatttttggtagagacgggagtttcaccatgtccttggggggcttg

SEQ ID NO: 22847 - DNA, 559 bp, Homo sapiens
ggggcacatattttacacttataaaacttgtggtataattcagtaattcctacccaaacataattttgccaacatgtaaaatttgaatatatacaattttacttctgcagacctttctgggagccctgatacttttaaatgatgtatagatatctccaaaatataaaataaagcagtgacaaaagaagaagcaaaagttttcccattgaagccttgtgctccttggtggcatatgtgaggaggaaaagtggttaagatttgtataaaagctgatggtaggccgggtgcggtgacttatgcctgtaatcctagcactttgggaggcctaagtgggtggatcactagaggtcaggagttcatgaccagcctggccaatatggtgaaaccccatctctactaaaaatacaaaaattagccaggtgtggtgtaatgcacctgtaaccccagttactcaggaggctgaggcagaagaattgcttgaacccaggaggtggaggttgcagtgagctgagatcatgccactgcactccagcctgggcaacagagtgacactctgtct

SEQ ID NO: 22848 - DNA, 742 bp, Homo sapiens
  misc_feature 1, 9, 24, 657, 708, 733, 740: n = A,T,C or G
nacgacagnagggaccttaatagnaaaatgatccggctgggcacagtggctcaagcctgcaatcccagcactttagaaggccgaggtgggcggatcacttgagcccagaagttccacaagaccagcctgggcaacatggtgaaataccttatctaccaaaaatacaaaaattagctgggtgcagtgatacacgtctgtggtcccagctactcaggagcctgaggcaggaggatcacttgagcccgggaggctccaattgcagtggtgaatcttggctgtcttgcaaggatctgagattgtgccactgcactccagcctaggtaacagagtaagactctgtctcaaatgagtgaatgaatgaatgatccaggaagaaaaaggaacattttatttgccagctctggaacttgtaacattgaattaggtagctattcaccattttaaatttacatttttattattctaaatatctttaacaaggacttttaacataggggtctttttaaataagtgttttgctaggcacagtggctcacagttgaggagccacttggtaggctgaaggagggtggatcgcttgagcccgggagttccagaccagtctaggcaacatggtgaaaccccatcgctcaaaaatgcaaaattagcctggctggngacgcatgcctgtatctcagcttcttgggatgctggggcaggatgcttgancccagagtcaggctgcagtgagcanatgcccnct

SEQ ID NO: 22849 - DNA, 542 bp, Homo sapiens
  misc_feature 55: n = A,T,C or G
gggttattttctttttttaaatgacggcttaatggccttcagtcacctacagggnaggctctgccattcctgtttgtggggctccatgtctgatagcatcatgtggtcacacagcacaaaatcatgatttactaggaccttaacaatgcatggtaaggcctttgaaaacatttttttacatgtccactgggacctgttgtgtcagttcataggatttttacaaaacacatacaaagaacaaataaaatgaccccagtcccaaaatgctctacaagtgcttattgtttgatatggaatgaagacaaaatcaagcacattccgttgttccagaatatgaaactgctccacagagtttcacattcattgggtttctgttgctattttgatttttctaaaagtgtgacatcctgtatcttagtggtgtgaaactgaaacaaaccaatacaagaggttccaattgtaagaatatacaattttgaattagtcacacagatgacagaagtgtaaaaatgttttttggcccaacgttacaaaatatttgt

SEQ ID NO: 22850 - DNA, 708 bp, Homo sapiens
  misc_feature 1, 118, 148, 215, 231, 235, 248, 252, 263, 280, 283, 286,290, 308, 336, 337, 338, 355, 359, 375, 382, 389, 396, 403,407, 450, 476, 484, 500, 516, 526, 538, 620, 631, 635, 646,648, 654, 678, 684, 701: n = A,T,C or G
ngggctggccaggctggtcttgaactcctgacctcaggtgatccgcctgcctcggcctcccagagtgctgggattacaggcgtgagccactgcacctagcccttcttttttttttaanaactttttttttgaaatggggtttcactgngttgtccaggctggtcttgaactttttcctaggctcaagcacccttcctgccttggcctcctaaagngctgggattacaggcntaanccaccatgcccancccntttttgttttnttaaaatgaaaaagttntanttntggnacttgtaaaaaacattanttgcaggtccaaagcacacatttgccgnnnctcagtccaggacttanctgngacaccatgctattgncaggatncagtttnctagatncaggatnctanaataggaaaaaaataaacctggtttaggggatcaaaatggctntttttagccatccaactcaacttatntgaaattnaattttcccttatttncaatgaggataataangtctaatgcntagctctgttgngaggaataaattaagtgtacagagtaccaaacatagagacgggcaaacattaggaatttaataaatgataattgctgactanaaaatcacttnaagnacaaatgttcntnttgaanaaaaaacataaaaagggaaagtcntaaatnttggaaactgaaaatanggttaat

SEQ ID NO: 22851 - DNA, 775 bp, Homo sapiens
  misc_feature 559, 651, 670, 674, 684, 693, 697, 704, 729, 736, 740, 761,770, 774: n = A,T,C or G
ggaagcagggtacttgctgctttgcaagtgtgtccacatctaattaatagtacagttcttactcttggtgtgtccggtgatattaaaaattaatgtgccttatttagataagtaacataaaaatcacaaaatgtatgccttagatttatatgtatttataactagtctatttcctgaaaacagttgagacaccttgtaaaagttaccggtacgatagggccattccaacaaagctgtaaagtggtgataacacagtcataaagaagaggagatagctctgggagaaaaggtggcccagaaaccagctctgagcctcatggctgcaggcaaggtctgcaggttcctggtcctgattgcaggccatttgctgccttgagtggtggttacacaaggccagccctgggggtatcacccagaacgcctagtacacgaatttcagtttagaggacgaagcattactggagtattgttatgcaggaaaactttttcctaaaatgccctgaaaagagagtagcctaatgcattcaatcaaaatgtttttaagtggaaaacatattgngtgtacttgatctggcctgctgcttttaaaagattaaaactgggactgggcatggtggctcacacctgtaatcccacactttggaggcagangcaggtggatcacctgagncaanagtggagacnacctgacanatgngaacccntgcctactaaaatgcaaaagtagcnggctggngccntgcccgtatccactctggagntgagcaganatgng

SEQ ID NO: 22852 - DNA, 712 bp, Homo sapiens
  misc_feature 1, 9: n = A,T,C or G
nacgacagnagggaacaacccaaatatcacacaccatgtaaaagatgattgttctgcgcatccagttgttaaatctgttgtgctccgagcatgcccgtgccaatccgcacgtactgattattcgctcgcagggttggtgactgtaacatttttgattaacctctctgtacacttcacaagcacttactctgggccatgttcagatcatgaagatgccctaaatcactgagatgttggtgaatatctgttgacatagtttttaccagtgtggaataactcagtgctcttcaaattcaaggagagtcaaaatagcatttttctctagctttatttgttttcatctcagagatactagacactgaatttcaatccaaaaaaagaatagaaaaaaattatttgagattacttatgtaatgcctatatgccaacatttctgtattcatagccacacattcaattatttggcaccaagttagccagtccttttaaagtctacttcttcaatgtttacaatccgaagtaagcaaaatgatgttcatctttaatttcaattctaaactctaatggtgtatggcaattttctaaaaaaaatctttatttctcccaaatatcttctataggaagtaagaaagacttctgttgtttgcttaatttaagccagagacaacttgacatttcggttactatttaccctttttgctgatgaagccag

SEQ ID NO: 22853 - DNA, 711 bp, Homo sapiens
  misc_feature 189, 303, 532, 597, 601, 638: n = A,T,C or G
ggggtgtgtgtgtgtgtgtgtgtgtgtgtgattttactgtgtcccttctccctaacactccagttcaagatagcaacctaagttctgagttgattattctggacacactctctcaaaatttgactgttggacaccagtaatacaccaccccaatataccaatatacctctggcatattgattatttcangcctagcatggtagctcacacctgtaatcctagtgcttcgggagcccaggagttcatcagcaggctgggcacataaggagtcccatctctacaaaagtattttttaaaaattanctgggtgtggtggcatgagcctatagtcctggttactagggaggccggggcaggaggatggcttgaatccagaagtttaaagttacagagaactataatcatgccactgcatttcagcctgggtgaaagagtaagaccctgtctctaaaacaaaaacaaaatagggctgggaactggtggctcacgcctgtaatcccggcacgttgggaggccgaggtgggcggatcgnctgaggccaagagtttgaggcctggccaacagtctctactaaaaatataaaaattggctgggtgngggnggtgcatgcctataatcccagctgcacagaggttgangcacgagagttgtttcaacccaggaggcagaggttgcagcgagcccaaatatgccactgccccccaccctggg

SEQ ID NO: 22854 - DNA, 666 bp, Homo sapiens
  misc_feature 599, 604, 628, 638, 653, 655, 661: n = A,T,C or G
aatgtttatatttgctaggttctactgatccacttctgaattacccacttgcccctcgggagacacataatgattttagggtgaggaaaatgctgctagaaaagggactttgtggctgggcgcggtggctcacgcctgtaatcccagcactttgagaggctgaggcgggcagattatgaggtcaggagatcgagaccatcctggctaacatggtgaaaccccatctctactaaaaatacaaaaattagctgagcgtggtggcttgtgcctgtaatctcagctacttgggaggctgaggcaggagaatcgcttgaacccgggagtcggaggttgcagtgagccgagattgcgccactgcactccagcctgggcgacagagcaagactgtctcacaacagaaaaagaagaaagaaagtgactttgtttgggctgcccggcaacggatcccaagatagtgattccagagcaagttgttacgtggaggtgaagaaaaccctacagggctgaggttgggagaaaaagcagtcctacagaagtgtattaagcaagtcccactggactgttaactttctccatggagaaatcctggagccccaaanaccancttaaagtaccaactgggcgcagnacctgaatanttgcccacttcccancnccttgngctgt

SEQ ID NO: 22855 - DNA, 758 bp, Homo sapiens
  misc_feature 295, 506, 517, 536, 558, 576, 578, 595, 601, 613, 642, 648,652, 663, 666, 668, 674, 681, 692, 698, 707, 729, 734, 740,752: n = A,T,C or G
agggtactaatttttggatgtttcaaaaggtcaagaagtaaaagatgttagaaagcaatgagtgagtccttttgatttttaacttattccccatgtccctatacttcgtgtgcttttcctttttttttgagacggaggctcactccgtcacctaggctagagtacagtggcacgatcttggctcgctgcaacctctgcctccctgattcaagtgattctcgtgcttcagcctcccatgtagctgatattacaggcacttgccaccatacccggctaatttttgtatttttagtanagatggggtttcaccatgttgcccaggctggtcttgaactcctaacctcaggtgatccgcccgcctctgccttccaaagtgctgggattacaggcgtgagccactctgcccggcttatttttctttatgtttttgcttcgtaagaggttctgttgagcagcgatttgcaactcttgctgacgttgctggggaagctttaaaaaaaaaaaanatgccccacanaaattctgattttaattgntctgatttaatgggctgggagnaaaattcaggctttgatntntttaaaaactccccagngtcganaaacaaatttanagagttgagaagtggggttttaaatacanaacttnctgngtttgggaacngananacaatngctttgntttttaaattncttganaagggattnaaccaatgggcccttggaaggngaatnctttgnaaaattaaaccntgcttg

SEQ ID NO: 22856 - DNA, 220 bp, Homo sapiens
gctactggccagtacttactgtagctgctgatcctggacaggctacttagactctgtgtttttcatttctttacttgtgaccctggcatggtatgcaggaaagtactctaaagttgagatttgtgcacatgaaacttagggatttgtgctctcaggatcagaatctgcagaagggaagaaagtaagattgggaagagggtgaatttgaattggtgcagtt

SEQ ID NO: 22857 - DNA, 705 bp, Homo sapiens
  misc_feature 596, 604, 609, 647, 688: n = A,T,C or G
ggggagttttttaaaaactttctttcataaagtcacaagaaaaattactatatttgaagatcttcattgtatatttatacaagttagcaaatgctgcctaacaaaccacctcaaaggtaattgcctaaaacaacacacgttattactcttgagtttgtgtatcagcagaatgactcctcctgtctcagtttgccttcattgtgtatctggagtcagctgtgcatcagtcagtcaactctgttgactgcaaatttctcttgaatggactcatctgtactctcctctatacattgtctgattttccagaaggctacacagggcttttgacatagcaatgactgggttcccatggaagtgagcagaagcactcatgaggcccaaactcagaaccagtggcattgccatttccatcatattctcttagccaatgtaaattgcaaggccacattcaggagatagaggaacaaactcccttgcttgatggaaaaggcagccaagtggttttgcaaagggtctaggtacaggggaagagtgaagaatggtggctattttggcattagctcttcaagtttctaattttgaaactatttatcaangctagggngtggnggctcatgcctgtaatcccagcactttgagaggctgangtggatcacttgaggtcaggggttcaagaccagcctggccnacatggcaaaacactgt

SEQ ID NO: 22858 - DNA, 685 bp, Homo sapiens
  misc_feature 1, 9, 22, 639, 652, 666: n = A,T,C or G
nacgacagnaggggagctgagnatcgtgccactgcactccagcctgggtgacggagtgagactctgtctcaaaagaaaatgttctggtgaaaactgtcagaggcattccattatagatcctctcatttaatggctaggagatgagagcggcagagatggaagagaaacctattaaattctgctgagaatctgctccctttcttcataacacccgtgtttctcatgtcgagagtagcggtgcactttgggtgtttaaaaaaaattctttgagaccctattactatcccatggtgtccgtgaatgaggtgggctgtcacaggagaactcttggagctatccctatctggactcatgctgaaaatccagcagtattttttccatgtcaccactataaatagaaactgatggccgggcgcagtggctcacacctataatcccagcactttgggaggccgaggtgggtggatcacgaggtcaggggttcaagaccagcctgaccaacacggtgaaaccccgtctccaccaaaaatacaaaaaaattagctgggcgtggtggcaggcgcctgtaatctcagctactcaggaggctgagccaggagaattgcttgaacccagaagtggaggttgcagtgagctganattgcgccctggnactccagcctggcnacagagcagactctgtctc

SEQ ID NO: 22859 - DNA, 710 bp, Homo sapiens
  misc_feature 646: n = A,T,C or G
gggggggagaaagttataaaattagcatacaaaaataatagcattcatataatcttacagtaagcagttagaagatataatgggagaggaaaaaagtcatatacaagaacaacaagaataagttttaaaaggtgtttctgcagctaaacatgttgatccttaaatacaaagaaaaataaatatgaatgaatacctaagaacagagacttctgcttctcaccaagatggaataacttacatcaaacaaaccaaagaaaaaaaccactgaggccaggcacagtggctcgcgcctataatcccagcactttgggagaccaagatgggcggattgcttgagaccagcctgggcaatacagtgacacctaatctctacagaaaataaaataattagttgggcctggtggctcgctcctttagtcccacttctttgggaggctgaggttgctgtgagccgtgattgagctactactgcattccagcctgggtggcagagtgaggctctgtctcaaaaaaacaaagcactgagcaaaatatgtgaaagaatagttttcaagactttggatatcaagcagtaaagaatggtgattcctgagaaataggaatcaacccgaagtatccctgtgggttgtttcagcttactgcctanagagattttccagactacgtaaaacagaaaagggaacccaggagaagctcagtagtctcaaagt

SEQ ID NO: 22860 - DNA, 772 bp, Homo sapiens
  misc_feature 338, 526, 557, 591, 634, 646, 659, 664, 674, 677, 680, 694,699, 705, 715, 716, 723, 729, 744, 759: n = A,T,C or G
gggatttggttagcagtcaaacttcaagttcccatcttggtgtgatggtctaggtttctgggacattataaacaagggtcttgggggaggtggtgtttagtggcctctgatctaattcttctactcttttccactcacttccctcactccataccctaccccacttctttccatctcaaagccgatgaaatttatttaatgctcagggcagagtgaaatacgttgtcttccttcagaaagtactatgttattgagacagtgtagggcagagagaggggagagctcatttcaaccattagcaaggcttagatttggtcaaggtggaccagatttgctgnttcttggggggtcagtgataccaacctaggcagatctgcaagctttggcatgacccatggcttgatcattttcctgaactgggacctcagtctgcaaaattactctgtgattttaatttgtagcaggtgcagcaggaggattgactaggcctttggctggcaaggcctcctgcttctcacctccttgntttgttatacactaagccttgtttgccatangccattgtgaatatgtgtgatgtggggagaggangatagactgacagcgacctcttgaatgaagtctggaaactgtnccacaaccgtcnctttgatgggctnccacntcacaactcncangcntgattcaccctctnttttntggacnctgagcctannaaggaanaacctncctcagtccaattancccatgtttgagccnctgcttttttact

SEQ ID NO: 22861 - DNA, 658 bp, Homo sapiens
  misc_feature 361, 365, 372, 375, 377, 380, 394, 396, 399, 410, 413, 428,442, 494, 501, 506, 559, 562, 571, 573, 579, 596, 598, 605,628, 632, 638, 642: n = A,T,C or G
ggggtagggtcatgctattgcaaaactccacagggtaccatttatgttgtattccatgtggaaggtgtcctctggagtttggcaatatagcagctgtctgtaaatgatattgaaagcatcctgagttctggagctgcgccgattctattaggctgagaaccccagtttcaagttcatctcttcatttttctctcattccatttcacagcggcttaacagcaggtcctttgtattcgtttctggcccatagagggatctttattcaaaatcacagggttgtctctaaatttctgctaagctaatgaatggtgttagtatgttctcttctccagggcagaggcagagttttttttttttttanttanccaaaancancnttncccaataaatcacntntcnttgtaaaaaanaanagttaactattatanctaaaagataaaangccatggcattcaggcaacgggggattaaaagtacttcaaacctatcagttntgtaaancctancttaagtctgtgggtctaactttctaactaaacttaccttcctttaaaaaatnttngatgtgcananagctanactgaggatctaccagncncagatcnccttatttcaatcaggacctaanattntttgangccngggtttaaaccccttc

SEQ ID NO: 22862 - DNA, 694 bp, Homo sapiens
  misc_feature 37, 38, 47, 179, 334, 337, 361, 363, 575, 635, 690: n = A,T,C or G
gggcaactcagccctggtgctctcattatgtcttccnnaaaccaggnaggcagttgcaggtcagtgattacccatggaaagagcatctggccaccaccaaaccttggcgttctactctaccctagaccagtaggtaagcccaagtccacacatgtctatagggcatatcctctggcctngtccaccttgtgtggctgagtaacaaccacaaaaatctcacccagcatgggagcctgtcatacagctgtgcccaactacaggttccaaacaacagagccagggaagacaacttgcaactctacctaatcagacatggctgcagagtccaatcagnggnctcacctgatggcaaagttcattntngtggtttcactgatcacagagcacagccagaaatactatttgatctcagagcacaggaagcagctcagcccaattatagaacctgacaccaagcaaaggctgccagccacccctccagaatctcaggctagactaaatggtaaagatctataaccaccaaaaaacacctgcaaaggctggaaaatttggctttctcctcaaatgcacaggcntaaggacacaaaagataatgaaaaatcaggcaacatgacaccacccaaaagaaaccaatnaagcttgtgtaatagaacccagaataaatggagatctatgaaatgactgacaaanaatt

SEQ ID NO: 22863 - DNA, 683 bp, Homo sapiens
  misc_feature 1, 9, 631, 641, 675: n = A,T,C or G
nacgacagnagggaagtatgagttagggatgattgcgggggtgtctcccacctccattatagtgttaggaggagtaggcttgggacttattacattgctgtctcttggagccagtgcaatatttacccaataaatgtgattgaatttgtacaaagtcattgtctgcagccatctctgttaatgtgcatgttctgtaaaaaattgctcatgcatagactttctattttaaatgtcacaattgagtcaataaagtaaacagagtttatgagtgtttacagttccaggaacacacaggggaatcctttattctgttttaaattaaagcgtcattcaaaaagaacaaactttcttaaatgttgcttttacatctttggctcagaacacagtatttctaactttgtttttcttattacttaggaaactagagaaatttctccttggaaatgtcagggggaaaatacagtatttcggattaactttagaaaactcaggtttaaggcttattgaccagaagacctctttcttatccaagtgtagggcaattcattgcaccttgaggtaggggaggagcaaaatcaggctggcaggggtccacggcagggcaagctctaggagctggtgagtctagaangacggactanagagagctggcattggaatggacaatcgctaganggcgccgg

SEQ ID NO: 22864 - DNA, 59 bp, Homo sapiens
  misc_feature 4, 11, 13, 17, 19, 22, 28, 31, 32, 39, 40, 46, 47, 49, 51,52, 58: n = A,T,C or G
tggnggcaaantnttgntntgncccccnggnnggggggnnggggcnnancnngggctna

SEQ ID NO: 22865 - DNA, 752 bp, Homo sapiens
  misc_feature 4, 7, 18, 22, 40, 51, 53, 70, 72, 74, 75, 84, 88, 123, 258,261, 418, 697, 743: n = A,T,C or G
attnccnctttgggtttnaatnaacccttttttttgtgtncttttggccgnancggcctacggtctgcgngnannagacaggangggnagttcggctggttcttctgtcgccggcttcaacancccgcgcccgggcaggtaaggcattccccgccttaatgcctcggtcaaacgtcgtccgaggtccgcttccaggcctcggcacctctgccccagggttgctggggtcggctgcggaacggaaatctctttatcatncgngagaaaagttagagaggaagtgggttcctttgacagagcttactccagaagaaagacttgggtaggtccccggtaatcaagaagttcgtcggccctgaggaagagcctgaggcttggagggacgtcacccagctgttctggggcgcagtcggacctnaagtttctcacctctcaggccctggtattccgtgaacccgactgcgaaatgaagtctcttttccccagaaccaggaagtcaggccagcacctgacagatgcctgtggcgccagcagctcgctgagcctccacacgattgtaattcgcttgtttctccggcctccaagcttccagggaattagaaagtggaggcggcttatgggatcagatgagtacattcgcagatgggggaaaaaagtgtacctgtcagcttggaagccagagggagacaaagggatnaaagcaaaccctgtccaggtgcggtggctcatgcttgtaatcccancacttttgg

SEQ ID NO: 22866 - DNA, 694 bp, Homo sapiens
  misc_feature 7, 20, 333, 468, 527, 533, 567, 606, 634, 638, 654, 657,663, 670, 686: n = A,T,C or G
ggggagnaacggcttccggngggagctgtgcagctccttatcatggggacaattcatctctttcgaaaaccacaaagatccttttttggcaagttgttacgggaatttagacttgtagcagctgaccgaagggtaagttattccttaaccccaattttaattattgcacaaacaacattataacattgaagaaagataatttttaaggccaatagaaatcactcctgatcctgtcacactgttttcatttttctatgttggaaaagtatttttttagtgtaaaattgcagttgtttggtgttaagttgttttactttggtaggaagcttctgntaaagttttgattctaattctgaagtgttttaaagaaaaatggttttgtggttgctttttgttattaagttttcaaaaaattaaatggatccagtctaaagccatgttttctcttttatttattttttttttganatgaagttacactcttgttgcctaagctggagtgcaatggcatgatcttggctcaccgnaacctntgcctcccgggttcaagcgattctcctgcctcancctcccaagtagctgggattacaggcatgggccaccacncccggctaattttttgtatttttagtanagangggggttcaccatgtnggncaggcngatctcnaactcccgacccaggngatccgcc

SEQ ID NO: 22867 - DNA, 309 bp, Homo sapiens
  misc_feature 4, 88, 95, 142, 209, 266, 267, 307: n = A,T,C or G
gggntttaagattgtcagacatatttttcatttagtgtctagtaatattttaaaaatgtatgtaattcattctgttacagcattttanaatgtanatttgcgacgtatttggcatttaagggaatgatgtcaatataatgtngatttttacacactttgtgtgtgtatccacaatgtgggttgtttccagattacttcaaacttgttancctttttgaaatgatcaaggtcaagctttttttcaactaaagaggaattcttagccnntagctgaagatctaaacaaaatgcttaaaaagtcctatanat

SEQ ID NO: 22868 - DNA, 666 bp, Homo sapiens
  misc_feature 180, 546: n = A,T,C or G
gggaactaaagtcactctattatgctatagaacactaaaatgtaatcctaatatttaactgtaattttgtactccttatccatccagcatttctttcctgaagataaatgctgtaagaattttttttgctgaatcttcttttctgagaagtttctctcagcaattctctcctatgcttgntgtttcctacaggcagtttatactccattgaactatgagtttatctttgtaattccaaaatttgattgtgttactgttctgctagaaaaatgacaactgtctaatccatgaccagatgagagctaaaacccttagtgtggtgtggaatcttgctattcaggtgtgatcctaaaaccagcagtattaccatcacctgcagtctcctttcagaggcagaatggcaggcccagccatgaccaactgaatcagaatttaaattttaagatcacccagatgatatattttcatttaaaagctgaagccctagttccaaagaccactccagtttagccttatcttgcccctatagcctggtccttccacctnctccttcccctccttctactttgtctccactggctctcccttctctaggctcacaatggacttttcctgcctctagctctttatgtacaaagtgacctctgtccaaaatttccttttcct

SEQ ID NO: 22869 - DNA, 679 bp, Homo sapiens
  misc_feature 18, 49, 176, 177, 179, 335: n = A,T,C or G
agggatatttaaaggttngccttttgcttctcgtgggtacaagccaganagagcagtggttacatgggggtagaatggtgactcgtttttacctgactgtggatcagctgggtggttcctgaatctcactgggctcattgtggctctttgcttgtcctgtatttactgtctgtggnngngagatagaagaaccaccatgttcttctggttctagactcaaactacagggagaaggaagagatgtgtctggcatcatttccgtgttggagtaactttgtggtagattgctgtggcctttctttgtggcctgccacttgtcttacattcttcagagnatttatgcacaggagcataaatatatgattttcatcttgccattgaaagtagactttccggccgggcgtggtggctcatgcctgtaatcctagcactttgggaggccaaggtgagcagataacttgaggtcaggagtttgagaccagcccggctaacatggtgaaaccccatctctactgaaaatacaaaaaagttagccgggtgtggtggtatgcacctgcaatcccagctactcagtaagctgaggcaggagaatcgcttgaacctgaggggtggaggttgctgtgagttgaaattgcaccactgcactccagcctgggtgataacagcgagaccccgtcac

SEQ ID NO: 22870 - DNA, 733 bp, Homo sapiens
  misc_feature 5, 14, 20, 33, 44, 46, 53, 63, 66, 73, 102, 250, 251, 265,282, 315, 317, 324, 331, 336, 340, 368, 374, 386, 401, 428,455, 457, 462, 465, 466, 468, 477, 480, 483, 493, 497, 499,504, 509, 532, 536, 544, 547, 554, 565, 579, 581, 589: n = A,T,C or G
  misc_feature 593, 620, 625, 661, 682, 683, 691, 694, 697, 702, 704, 705,708, 713, 726: n = A,T,C or G
tttantttggggtncgaaanccttgttttgttncttttggccgnancggcctncggctgcganagncgacagnaggggaaatccagtaatttcttgagcagnaagaagggaagtggaattactgtagaaattatgcatagttttatattatctgtgtagtagcctgtttaaagtgatcattgctagtgcatggtatagaattacaaacttgtaaatacttctcaagattgccactttaaaaaaaaaagcnnaaagagctctgtanccctatttttttttttntttccaacaggaaatttgttcttgtttcaaaangngggaacncccattnttctntgtnggccacatgaatgtcatccatttgtttnttgcancaaaaaaaaagngaaaaatggttgatncaggggcaagctgttccttttaggttnctttaaaaagtcatggaatttcggatntncaaanaanncntaaggaatnctntanccagtttatntgtntncagtntccantttaaaaatgaaaatgtaatgtngttnttaaaacnttntgtgtgngcttccacaancctgtcctcctttntnccttccanaagngacttctctcttgaatttggggttcgncattntgggggcatgctttaacagttttacaaaataccacncccattcccaaacataaaaannctgtttcncancanaaatngnnttntgggnacatgttttaaancccaaat

SEQ ID NO: 22871 - DNA, 661 bp, Homo sapiens
  misc_feature 16: n = A,T,C or G
gacagtagggtgaggnattgttggtgaggagttggattgttgttgtatgaggaagtgcaccttggaatctaatggggtcttcacgggagggggagtcagttgtggcactgtttgtgtattccattcatcattcatccctccatccaagcacccacgtggagctcagaaagatgactaacacataccccctgctgctcctgtttttctaaggtgtgctgggaccatttacatttagttctttggagaacacaactacttaggatttttgttgttgttgttgttttcctgtacattgtcttcctatctcccttctggtacccattccaccctctctccccttcctcactgccgtttcataggggttctcagattcctgtgaataaagcaaaccgatgtgcagatatgtgtgcttacacatgtggacgtatttgaggaggtaagagggacctgcacaaggctttagtgagtaagcagagaagttatttatatatagtgagacccagtaaacggcgatgtcgcaggtgaggcagttgatctggtcagaatatgcctccagagacatcactggtgaggcctgcatgcatgttgaaaagagtgtatcttacatctaggcttgggtttccccctgcagctcacttatgaataacaacgtatgcaagag

SEQ ID NO: 22872 - DNA, 693 bp, Homo sapiens
  misc_feature 4, 11, 14, 25: n = A,T,C or G
gggnatctganaangaggagaaagnagtctgggattcagggatgagtgagggttacagatcactagtcctatacttttgacctctgttcattagaacctccagagctttaggttctagggacttcgctgcatctttcctgcagagcagaggaaagttggggagggaccataaagagagaaaggtggtcaggcccagtggcctacatctgtaatctgagcactttgggaggcctaggcaggtggattacttgaggtcaggagttcaagaacagcctccccaaagtggtgaaaccccgtctgtactaaaaatacaaaattacaaaatacaaacatcagccaggcgtggtggcacgagcctgtaatcccagctactcaggaggctgaggcaggagaatctcttgaacccgggaagtgggaggttgcagtgagctgagattgcgccagtgcacttcagccctggcgacagagcgagactctgtctcaaaaacaaacaggcaggcgcagtggctctctgtaatcccaagcactttgggaggccaagatcggtggatcacctgaggtcaggagttgaagaccagcctgaccaacatggtgaaaccccatctctactaaaaatacacagttagccaggcgtggtggcaggcgcctgtaatcccagctacccgggaggctgaggcaggagaattgcttgac

SEQ ID NO: 22873 - DNA, 718 bp, Homo sapiens
  misc_feature 179, 602, 616, 636, 645, 666, 682, 685, 714: n = A,T,C or G
tagggggtgtgtttggggaactaaaaagaggccggtatagtttatttccttcattattttgtcttacatttcctggtctttgggaatataaaaaaaggggaactgtgtaaactgagaaaaggtgcagtaaacaccctgcaaataattctgcattcagcatatatattcttaacagagtngatagctataatgaattataaattttgagaattatagtagaggtatatactgacctagaaatgcctctgttcagggtgataaatatcttaaacatgagagatttgctggtcctcaggaagtaaatgttctctgtagcataggactctagttaagatgagtaaaaaagctgattgtagagctgtgatttcatttaggaaccccttttcttttttatttttttgagtaggttaattgcagcagtttcctcattttatttcttggtactttatcacccatcaaaattttaaaaaacttttccctaattggccaatgttcttatttttttctttcttttttcttaaccttgaaagcatcttgttttttttctgaccgaaaggtatctgccgctgattatttcagtcgctccaatcgtaggggaaagngttgtctctgaggnggatgatatcagtatcccanattgtccancgtgagtgtattgcatggggngggtggttattgttgnccnagcttgggactacagctaatatgtagctnttta

SEQ ID NO: 22874 - DNA, 718 bp, Homo sapiens
  misc_feature 2, 593: n = A,T,C or G
gnagacagagggcatttgacacagtgggagcagagcagatcggaggttgagtaactctttcaaagacacccagtgagcccagggtggggccagagcacaatgctggggcgcctcgactcccgacccctggccctttccaccggaccccactgccgctccttaaaaggcaccgtttgccacgcactttctaaacacattacctcatcgaattccactcttgtgagctatactgctttccttttgggacaaggttttcaccattttgagccccagttgcaccatctccaagttggggctcatgacagtccctgcaaatgaggtcacggctcagcaggtggaagcacgctggcaccgattggaagttccagaagtgttatctgtgtggctttctcctttcccctacccccagccacatcttaaacaggaaacaccgggcttcccaagccacttctgagcgcactctcacgcttacctctgtggcagccgacggagcgtctcctgggagcaagaacactcctgctagacagctgttaactaccaactggaggacaagccagttctccaccttcagccagcttgctgggtgagcttangagttcacagcaaacacatggacacatctaaagtctaaatgctacaggagagatgacatttaccaccatggtgacagagtacagactggccgcaagccctgaaaagcagcacatctgcaaaaggg

SEQ ID NO: 22875 - DNA, 421 bp, Homo sapiens
  misc_feature 329, 386: n = A,T,C or G
gggatcatctcagagatcaccacggactgatagggatatcagcatatcaccgtttagaaaagacttcttttttaatctatgagatgtttacactggttttgtagagaagatcaagtgacaggtataccgtaacttttttgattacacgtttatgatagattctagaaaatgttcactagaaactaatggaagcaaaatgtaatttctataggcatttacgtttttaaaagtttgtaggagacacacgtaggtaccatcttacaaaactgaattcatcaggctgtttgattcgtcatcatcaaatgactggtagcagcaaataaattccngcatatcttttgagcagtggtgactgacttttacgaccaccaggaaccccttcattntttcattctcaattgacttcttgttaaaatggttt

SEQ ID NO: 22876 - DNA, 109 bp, Homo sapiens
  misc_feature 1: n = A,T,C or G
nacgacagtagggatccaaattcaaaaaggcatctgaaaaatttaacagctgaaaaacactttctccttgctgggaaaacttaaaccttgctaggctttatgcaactta

SEQ ID NO: 22877 - DNA, 373 bp, Homo sapiens
  misc_feature 312, 326, 327, 328, 332, 333, 338, 342, 344, 346, 356, 358,360: n = A,T,C or G
gggatttataacaaaatcaataccaagagccttcaaagattgaattctgctcatcaaataggttcacatgctgaaatcctaatgccttccttctccctttagaaattaaattctgaatgtgcccaaacctggataatgattaaagatagatgagttcttggctgggcaccgtggctcatgcctgtaatcccagcactgtgggaggctgaggtggaggcatcacctgaggtcaggagttcgagatcagcctggccaacatggtgaaactctgtctctacaaaaaaaaaaaaaaaaaaaaaaaaaaaacccctnggggccgttttttnnntaannccaancttnananaatccttggngnanttggacacccccc

SEQ ID NO: 22878 - DNA, 669 bp, Homo sapiens
  misc_feature 427, 478, 542, 564, 599, 618, 632, 646, 652, 655, 657, 659,660, 661, 663, 664, 665, 666, 668, 669: n = A,T,C or G
gggggaaccaccgtggcatatgccgtctgtcattgactgaaacgtcattatgcagggcatgactgtacttacaaaattagatggcacttcttaggaacattcctttgctatgagttgttttaaaacttaatgtacttaaattttttttattataaaaaatttccaacataaacaaagagggagaatgtatgtatattaagggtctcactctgttgcccaggctgtagtgccgtggtgcgatcatggctcactgcagcctcgacctcctggactcaagtgattgagggagaatattataatgaatgactttatattcctcacctgggttaggatgaaatgctaaggtcacagctaagcaaaagccactttaaaggaaaggaatgttgctgccacgagtggcgttcctgcagaaaggtcattaagtcanaattactactctgtgttctggagggaaaataccatgacactaagaatttanctgtgggtcagggaggcattttatgtggtgtgaatcaaactagggagccttgggctgggtgcanaggctcacgcctgtaatcccancactttgggaggctgaggcggatgcatcattttangtcaggagtttgagaccancctggccaacatantgaaacctcatctntactanaananannnannnnann

SEQ ID NO: 22879 - DNA, 683 bp, Homo sapiens
  misc_feature 4, 5, 27, 34, 47, 48, 51, 53, 58, 186, 188, 190, 193, 205,211, 215, 221, 223, 225, 229, 230, 240, 247, 260, 266, 269,279, 285, 288, 292, 300, 310, 313, 318, 322, 323, 324, 327,335, 352, 354, 363, 366, 368, 370, 373, 374, 377, 381: n = A,T,C or G
  misc_feature 382, 385, 391, 393, 406, 410, 421, 438, 441, 447, 454, 459,472, 475, 497, 499, 500, 504, 506, 513, 514, 549, 553, 562,564, 567, 573, 584, 587, 594, 596, 607, 612, 616, 645, 651,653, 660, 664: n = A,T,C or G
actnnctttgttttcgataaaccttgntttgttncttttggccgcannggnanatagnaggggtaggcagggtagagcttgtgggaccttcagtgctgactttagccaccatttccattcctatacagggtgtgaaggtcagaaggcagccaattgttggtttaattttttttttttttgaaacantntnttncccaggctggantgtagngatncagtcncngntggnngtaccctcanccttccnggctcaaaaaatnctcccnccncaccctcccnggtagngantacntggtcctncaggtgtgtnctnccccncccnnntantttttttntaaaaacggggtttccntnttcccaggntgntntnaanntcntggnntcnggggancntcccccctcggcntccnaaagggctggnattcctttttttatttntgnaaaatnttttttntggtnggctttttggggnaanatttcgaggggcctcccctttntnncttnanttgttgnnaagggatttgggtgtttctacccaaggctttggtntacnttttcctanangancttatntttgggggttnaanctccccncnttcccccattnggggncctnggccctttcaaagggaggggcctgacccnttgccntnccccccncttnccccaaatttgttttcccc

SEQ ID NO: 22880 - DNA, 737 bp, Homo sapiens
  misc_feature 4, 5, 13, 16, 20, 21, 33, 44, 46, 54, 614, 621, 722, 732: n = A,T,C or G
tatnntttgggtncgnaaanncttgttttgttncttttggccgnanacgacagnaagggtcccacccatttcccttgttttccaataatatagaacttgggaagtaaattgtggttttagttaaggcaaggttcaggtcctgtgttcgtctaataactacataagattccatggtgtgctggttagctatattttggggagataaaaatagtactgcgttatagtgtttgctgatttccgtggtgtacgtaattccaccaaggccaatttgaagctaacaacatgaaattaaccagccagaaggatttctgaaaatttaactatctggtctcataagctggtaaaaactgtctctaatatacctatactctttaaaagtcccaaatccttcccatgttttcttaaatgttgctaaggtttacatgccctagatcacttctctctgtgagttctgctcttacttacttggttcagctcatggactggcttcttaattctctgtatgctggccttttgtttttttccataaaagcacttttctttagtttccataaaatccattttcagaaaccagttgtgcaaagcatagaatttttttaaaaagatacctgcanatggtanaggggatggggaaagttcttactatgtggcaatattaataaatacagattaagtattggggtatctttgctatttaatatcctcaggctactcttcactgncctttcccangttcc

SEQ ID NO: 22881 - DNA, 680 bp, Homo sapiens
  misc_feature 4, 593, 657, 674: n = A,T,C or G
gggnaacagttacaagtttccataaatcagttagaatatgactagcttcagggaaggaattttcaacaactgcaatctttgattgttttactgtgggaacttgcagtgatataattgacaacattatttaacaataataggtaaagtaggccgggtgtggtggctcacgcctgtaatcctagcactttgggaggccgaggtgggtggatcacaaggtcaggagttcgagaccagcctggccaatatggtgaaaccccgtctcttctaaaaaaatacaaaaattagccgggtatggtggcgcatgcccgtagtcccagctactggggaggctgaggcaagagaattgcttgaactcgggaggcggaggtcgcagtgagccgagatcgtgccactgcactccagcctgggtgacagagtgagactttgtctcaaagaaaaaaaacaataataggtaaagtatttaaggaattctcagatgccttatggacctcttcaaaaatgtggttagccaattgattcaacttttataggtttatatgctctcatgtaaacctatttgtttccgagatcagacgagatcgggccgcgttcangggtggtatggccgtagacaacctatttgttaaaaacccttggaaacacatcttttagtaagangttcttatttacttatnaagatt

SEQ ID NO: 22882 - DNA, 726 bp, Homo sapiens
  misc_feature 2, 24, 33, 39, 40, 43, 49, 58, 63, 68, 69, 73, 86, 92, 126,153, 155, 168, 170, 171, 178, 183, 192, 193, 194, 197, 203,257, 277, 282, 291, 305, 308, 311, 314, 359, 385, 389, 428,430, 440, 463, 493, 609, 614, 620, 640, 643, 656, 658: n = A,T,C or G
  misc_feature 665, 666, 694: n = A,T,C or G
gncgacagtaggggactgctgcgnagggtcganattatnntgnctttgnttttattanaactntaagnntctnactcgctttaatnctcaantgtagccgtatgcaagattacgacaatgtacttnctgtgtattgatccaacaacactctgngnttgccctacatantnnatatagntgctnttctgtgtnnncgntttatnatacaccgagctatcattacgtctatttgtcacagttacataaataactcattntatcattttatttattaagnccacnaaactgatnttatgggtagaggnatnagntgngctatttaatcttactctggcggatgaatcaacatgtggattcanaaggtgttgagtgagataagactctngatntgttagaagaccactgctctaggatatgtgtagaaacananctgacacatnggaagtacttaatgaatgtttgntgaatgaataaattttcaggcctgcctganatatctatgtgacatgtgtcgacacatacagcccctctggtgctcagtatcatattctgaaaaatgaaggtgttagacaaggatttctagcacctgttttacttctaaaattctgngatgnggtggnggctcacacctgtaattccngcnctttgggaggccnanaccagcnnattgcttgagctcaggagtttgagaccngcctggacacatggtgaaacccctctctacca

SEQ ID NO: 22883 - DNA, 668 bp, Homo sapiens
  misc_feature 607, 643, 647: n = A,T,C or G
gggatctattgcttttcccttttctgtatggttttccactccaccagagatgaaaattaaattgacttgtcactattttctcctcatataggcattcatcttgctcagggctttatttcttcaaattattccaatggcttacttaacagatgtagtttctttcttagttaaatcaaaaggtatttattgagcaagtactgctaatactaccactgctactgctggtactgttaatactactgtctctactactgcaatgactggtctcatagtgttttaggctgccttcaaggtgcatcaccttatttaaattgtacaacaaacccttaagttatgtacaattatatgaggaactaggcctcaaaagttttataatttcctccagctcgtagtggcagggctggactccaagctgagatgtgtctggttgtccggttctaaacctttctacaggtcgccttgtaaagaataaggatggagctcaaacacagatacataaaggaataaaattaaaacttgttcctgcttttaaaatgtagtggttgaaaagccagaagtataaataactccagttctgtataaatgatattctcaaatgctgcatcanaatcgcttggggagaatttattaaaaacatggattnctanactgcaaccaaaactcttgga

SEQ ID NO: 22884 - DNA, 658 bp, Homo sapiens
  misc_feature 624: n = A,T,C or G
gaagggatttttgaaaaatcattcttactcaaaaagtgtcctacttagaataagtccagtgtgaaagctaggtgagtgtaattttttatagtcttgtaaatttggtttgtaatttaaaatgccttctagacataattttaaatgtgaattagtatctttcctttcaaataatcctttgggcatgaagccaaagaaggacaggaaacatttttcacttccttctcccacattgcagtcgggaacagattgcataaaggaggactgaagagtagtctgattttctgtgcaagttgtacaaattaaaagcaaccaggccttcacaggctagctcctgatggaaataagatgtgttttcggcatgagctgtttttcttgaactttgtttacgtctagtttgtcaaaaagataacagacttttctctttataaatgtcttggaagaaactgatgcatgaaattcgaccagaatttcttcagagaaatgttttagtgacagttgtgcaagtagcagaatggttatagaaacctggccattgctccatgttcagcatgtcctggtcagtttacacttttatgtctgtaaccctgaggtgcacaagtatgcaaaaatagataaattatccgncttcatgggagcttgcataggtaaaccatatacc

SEQ ID NO: 22885 - DNA, 659 bp, Homo sapiens
  misc_feature 569: n = A,T,C or G
gggataaatgaagtaaattgtgagttaagtgcacctaacatttgttcattcttagcaatgagtagttgtccctggcatttctcttcctcttctccattatgactaaattggagctccatttctgttctccaccttcttgtcttgttgactactgcagattttgtggatgactgagataaactcattttataacctctttcttatatttatgtatccctcttttatgcaaccccagggagagcatacaatagaaagacaacataaggataggtgagaagaaaaataaatcatatgtttagtttttcccttcccttcattatcatctacctaggcttttaactccattaatatctaagaactaagattcgattcttatctgtcactccagaggcatcattatataattatcaccctggtacattttctacagttaattgagtttgaattttttttatttttttataaacggagtcttgctctgtcgcccaggctggagtgcagtggcatgatcttggctcactgcaacctccaccttctgggttctcctgccttagcctcctgagagtttngaaccttttaaaaaatgtaaatcatttttctttgatttattctgggctctaaaataaatatccatggcactttctatccataaaggttct

SEQ ID NO: 22886 - DNA, 614 bp, Homo sapiens
  misc_feature 11, 27: n = A,T,C or G
gaggccggagnaacaaagcagtcaggnagcgataaaggcaggtgatccctgctggtttgccctttctcccagctctgaccgtcaccgtcacacatgacattcttgaatgaggtcacctgctcactacagattctaaaaggggcttgcttggcaaagacctccagggtcagagtgccggcctttactgtttttggcagttgtgtgcatggaacattggaagcgtttggaacggaatgcttaaggaagatattatttggcagcaagaaaaagggagtgtgcagactccccctacccctcctgggatgagtaggtactgcctgcccgttttttctctacaggagttgaatagtagccagagtacaggcttggcatcagaaggccttagttcaatccttatctcttctacctaccagcagtgtggctttatgcaagctcttgttcatctgaaccttaccgctcttgtctgtaagggatagcaatatcggttttacagagtgggctgaaaggttaaaagaggcgctagttctttttggcatgcagcaagtataaagtaattgttgctgttcacctcctctccatgattaaagagtaggaagttgggaaaagaaggtgag

SEQ ID NO: 22887 - DNA, 717 bp, Homo sapiens
  misc_feature 2, 244, 267, 273, 297, 338, 345, 358, 368, 372, 378, 400,427, 512, 554, 590, 614, 639, 645, 656, 668, 670, 686, 688,690, 692, 706, 714: n = A,T,C or G
gnagacagtagggggatgccaaatactaaaggaaagaaatagatcaatctgtccccacagaacgcagggaaggcccaggaactgggggccactggctacctctgagggcagtgagtcgaacgaggacagccctttaaagcctctaaaattagtaagtcgaccttctgaatgccctcccctgctttgatagccgcatacccttcctcccaccattttctttttttttttaaaacaagtttcactntttcatccagtctggactgcagnggcacnatcactgctcactgcaccctccanttcctgggctcaaggaatcctcccaagtcctcagcttccanagtagcnggagccacaggcncacaccaccntgcncagctnattttttaatttttttgtaaanatagggtcttgttttgtttcccaggtnggtctttaactgctgggctcaagcaatcctcctgccttggcctcccaaatcgttgggattacaggtatgagccagcatgcccccntgcccgccctacaattttctgttctttctctctgataagttnaatccaaaggttttggacttaggaaattaggctcantcgaggcccacggggaaatccccncgttgaaaatagcaggattcattgnaaggtntaaacgttttncagcagggcgtntnttccctctctactttntnangnactttttctcaggngcttgaanaag

SEQ ID NO: 22888 - DNA, 738 bp, Homo sapiens
  misc_feature 1, 20, 23, 31, 209, 210, 365, 369, 600, 612, 644, 679, 697,726, 731: n = A,T,C or G
ncggcctacggcctgcgagnagnacgacagnagggaatgtgactattaaccacccaggggatcctattaaaatacagattctaattcagtaaagtgtgaggtggaggccaatgatgtgtaaataagaccatagagcaggagtcagcagcctctggcctgtggaccaattctgaccctatgcctgtttttgtacagcctgcaagctaatnntgactttcacattttaaaatgattatttttaaaaagaagaagatgtaactgggcattgaaggtccacaaagcctaaaatatttactatctggccctatacaggaaaagtttgctaacccatgatctatcttcataaggttccccataaccactgnaagnctcttctcagtattatcccactttattggatcctatagcctcttgtcttaggaattcccatacttaggaatttgtttttatataaaagaaatgaggtctgggtatagtggctcatgcctgtaatcccagcactttgggaggccatgatgggctgattgcttgaggcccggagtttgagagcagtctggccaacatggcaaaatcctgtctctacagaaaatacaaaaaatntccaggtgtggnggggtgtgcctgtaattccagctactccagangttgaggctgagaatcacttgaacccaggagacanaggttgcagtgagctganatcaccccctgccctccagtctggggganagagngagactc

SEQ ID NO: 22889 - DNA, 507 bp, Homo sapiens
  misc_feature 4, 9, 25, 26, 27, 28, 30, 41, 46, 48, 54, 75, 76, 87, 88,90, 101, 140, 220, 225, 228, 236, 258, 263, 280, 284, 326,330, 339, 343, 376, 378, 411, 414, 425, 428, 435, 438, 446,457, 461, 462, 470, 473, 478, 492, 499, 502: n = A,T,C or G
ttanaaaanccccctttttcaaacnnnngnccaaaccggcncttcngntgcganaaccttttgaagggattccannatttggggggnnangggggatatanaaaaaaaaccccattactactcttgcggggattgctagnctcacagacctcctgaaccagctgcctcttccatctcctttgcctgctacaactacaaagagccttctctttaatgcacnaatancanaacatgtnaacggggggggggggcttgtangtatnacaatttggtttcacanctcntccataaccacaaccgggtatcaacagcatcacatagagttnaaanataaccttngcantgataacccaaaaggggacataccaaaacttgntncatgccttcctaacaacgagtccggggggggtncangaaaaaaagcnttnttttcanatntgtccaanctggaatgatnatgnntcaagtanaancctcncccaggaactccangcacacnaancctac

SEQ ID NO: 22890 - DNA, 656 bp, Homo sapiens
  misc_feature 23, 614: n = A,T,C or G
gggaatcaaaatgcctgcaaagnactacacagttgcaagggacatcagcttatatcccaacattattggttcctgatccatagttgtgagaccttggttgattccctgatagtacagcaactccctgggaatggaagttcaacttgttggctttagaacaacataagcagtttcattgaacattcactgaatgtctcctctgtgctgagcccatgtcagggactgggtctttaatcatgttcttgtatgcagcatccctgcactctacctgcacatgacttctgaacagcatgctctgcccagacagcctcagtgagggccaggacttgaaccctgtggaagcatgtaaagacatatttccgtggtggcagaaggctgagagttcagcatactgtctgtcttcacttttgagttgttctttcatctgcctaagactcatggcagagcactcatttcacaaactttcactgagtgccgactatgtgccaggcactgtgccatgtgctgaaagtacaaagactttaatatgtagtccttgacctcaaagagctcaagagtaattgacagaaattcctagatcatgatctgtgatgatgagaatcattccttagaanggcttgcatataaacatatttatatacttattttgtaagaaa

SEQ ID NO: 22891 - DNA, 797 bp, Homo sapiens
  misc_feature 3, 7, 10, 12, 17, 18, 29, 37, 41, 59, 61, 63, 64, 71, 76,77, 114: n = A,T,C or G
tantacnggntngtaanncttgcttgttncttttggnccgnagcggcctacggctgcgnananncgacagnagggnntcttgtaattttcacaacacatagcaattccccatgnagtagtttaatcaccacagtaagcgagttctgtatggttgctccaagtgagggtgagagtagagaaatcaggttttcttcttcctataccctctagaattcttatataaggtgatgatgtatcacaaaggaaattcctcaatatcatactggaaatagtggaagtagacaaaaattcaagtccctgtgtcttaatggaagttcgttctttggagcggaatgaaaagttcaggaccaggttaaacttccactagtaaccgacctcaagcagcaagagtatactcagaaattggtatggagcttgcttggattttgtataatagatcagtcatgtcacctgaagctgtgcccctgcctactttatttatgtcacctctatagttgcagtcttacagttggtacatgcatatgctttttgatgaaaagaaaatggagggcaaagatctgttcttgtttctcctgccttcacataatttctctttattcaacattactcttctaagactttcttataatagctattgaggcaaaagaaaagccaatctgaatatattaattatttttatatatgaagatggttaaagatttcagagttaaaaaatatggagactttagtttttcctaaaaaagatttcctttttgtttttctgaaaaacaaaactggtaccaaaacataactggtac

SEQ ID NO: 22892 - DNA, 570 bp, Homo sapiens
  misc_feature 6, 290, 324, 440, 460, 471, 480, 495, 503, 506, 511, 513,518, 532, 544, 558, 559, 561, 563, 568: n = A,T,C or G
gacagnagggtatcttcccccaaacataactcattacctgccagtttatcccatgtacacttctttttcaccccagttttcttttattttcagcgatccattccagatccaatatctttttttttgagatggagtcttgctctgtcgcccaggctgcagtgcagtggctcgatctcggctggctgcaagctacgcctcccgggttcacgccattctcctgcctcagccttccgagtagctgggactacaggcgcccgccctcatccggctaattttttgtattttttgtngagacggagtttcaccgtatgagccaggatcctntcgatctcctgaccacatgatctgcccacctcggcctccccaagtgctgggattacaggtgtaagccacctgcacccacccctccagatccaatatctttttcctccatcctttgncaaaccaggacttcagcttntggttactggngcccacttnaagagatgccaggcngggaactntcnggacncntaccnggcctgcactggcntttgtatttttnggagacaggatctnngncnctcanaa

SEQ ID NO: 22893 - DNA, 236 bp, Homo sapiens
  misc_feature 3, 10, 77, 83, 85, 86, 87, 91, 101, 104, 110, 114, 115, 123,146, 161, 165, 176, 203, 207, 211, 216, 218, 221, 222, 230: n = A,T,C or G
tangggtacngctgcgataagcactactgaaagggtacatgctgcatacaatacgatgactgaagggtacggctgcncagaanannnctgnaagactactnaanggttcngttnngaaaagangacagattggtacgtgctgcganaagacgacatattgntccngctgccatatnacgacagattggtactgtttgcgactntacnactnaaagntnctnntgatagtnagacca

SEQ ID NO: 22894 - DNA, 743 bp, Homo sapiens
  misc_feature 1, 5, 637, 659, 669, 676, 706, 712, 717, 732, 736, 737: n = A,T,C or G
ngggnacatgttttgctgacagctgttttttttctctctttccgtctctttgtctctgtctcaagacagggtctcactccatcgcccaggctggagtgcagtggtgcgatcatgactcacttcagccttgacctcctgggctcaagtgattctcctgcctcagcctcccgagtagctgggattataggcacctgccaccacccccagctaatttttatatttttagtagagatgggattttgccattttggccaggctgatcgcaaactcctgacctcaagtgatcccctgccttggcctcctgaagtgctaggattacaggcatgagccaccgcatgtatagctaaggtaataaagggaattgaagggcagtgtgttttagtgcagtctggctgcttctcctttctagtaattttggtgcagtgcagtgtttagaatcatggccttgtcaccctggcttccaaccctagctaattgtgggtcttacgtcaagtaatagttctaactttgttgagcgtgttaagtgcttaacacagtgtctaccattattgatgcctagcaaccaaagactacctggaacacttttggtcaaacagaggtttattagattatgaaaaaaggaaaaatacacattacnaggaaaagctggggcttgtcantaagagggantaggaanggacttggatatgtttggggctattctggngatttncctanggcttaaggggatangctnnttctgg

SEQ ID NO: 22895 - DNA, 685 bp, Homo sapiens
  misc_feature 2, 11, 16, 18, 20, 23, 26, 47, 49, 50, 58, 75, 578, 579,586, 633, 642, 654, 658, 662, 663, 664, 666, 670, 673, 674,675, 676, 678, 679: n = A,T,C or G
anataaactgngggtngntnaanccntgctttgttgcttttggccgnannacgacagnaggggtctttcctccanggagcaaagggcatatacggtcaatgccatagtaagtaacactgtattatgttatactaaaatattaataaatctaggttggttcagtctttcctgagtccacagattggaagcagattgaggaaggacgctagtggaccacagagctgaaccatgcacacagaagaaatctttttttctttttttctggagacggagttttgctctctagttgcccaggctggagtgcaatggcgcgatctcggctcactgcaacctccacctcccaggttcaagcgattctcctgcctcagcctcccgaggagctgggattacaggcgtgagccaccctgcctggccacttttgtatttttagtaaagacagggtttgaacactggggcccaagggctggtctcaaattcctgacctcaggtgatccacccacctctgcctcccaaagtgctgggattacaggcatgagccaccgcgcctggccagaagaaatctttatcttggtgtgcanngtctggngagggacaaatgtcatctctcttggatctgaatctgaaaggatcaangcactgaanggatttttttgnttanacannntncctntgnnnncnngctgga

SEQ ID NO: 22896 - DNA, 644 bp, Homo sapiens
  misc_feature 547, 563, 573, 576, 577, 590, 605, 625, 626, 643: n = A,T,C or G
gggggtttttctttttataagttgccagatctttcctataacaataactgccattattgagaacctactgtgcgcttattctgtactgagcactcagatcttcagagttttttcttacttaggactttttgtttaactctaggtgtaaaaatgaagaaaaaattatatctcatgttgtgaaagagtcagactctgaaatctgcttatactttgctatttacagtaagtacttttgaaacagctgtagacgttcaaatgaaagtagcaatgtggagtggggaatgtgggaacattcatttgtgaagactttgcatttcttcagctttatagccaacagaaaaggagattgttgtgcattctattaaatactgccagtatgattaatttaaagggttacattttattgaaccctggtgtagatgttctttgtcaacccacattcacagctagttagagtgtgtgtagcatttatcaaaactttctggagcccctctcacctcattagcatctgaatctctattcagcagttaatgtccgttactgctanagtgctcaattcttgntttcattaanccnnttgtaaatgtcanactgtcccttacatntaaaaaaccaaaatgatggnntttgtaaaaatgtatcnc

SEQ ID NO: 22897 - DNA, 486 bp, Homo sapiens
  misc_feature 384, 390, 392, 394, 398, 408, 415, 424, 425, 428, 442, 446,462, 465, 471, 474, 476, 481: n = A,T,C or G
ggggtttgatgttattagtgctgttaacatacagcaatggaaaaccacactcaggagttgtatctgttgttgtttatactcctttggatgctgtgctggttagtcgtttcccattcctttggctgtaagaatgctgatatgtctgggaatagaatgctataccacgaaataccaaataatttcaaatggtgcccttaaattgtatcacttttttaaaaattcagattcttattagtaaaattagttgatagcactgtgctgaccaagttgattgtgatcatcccagcttagacttttctaaaaacttttttttagaataatctataaactgaactttagtatgcatttcagatatttaggtatataattttttttttttttttnaaacanantntccntttcccccangctggantgcaggggnnctnttttggttcattgnaacntccacctcccgggttnaancatttntcntncctanccttt

SEQ ID NO: 22898 - DNA, 751 bp, Homo sapiens
  misc_feature 1, 19, 567, 569, 571, 637, 641, 650, 655, 658, 665, 670,680, 683, 691, 701, 703, 720, 721, 725, 733, 743: n = A,T,C or G
ncggcctacggtctgcganaatagacagtaggggcaaatgtgtaaaatatcaatactttatgttcaagctggggcctcttcaggcgtcctgggctgagagagaaagatgctagctccgcaagccggagagggaacaccgccacattgttacacggacacaccgccacgtggacacatgaccagactcacatgtacagacacacggagacattaccacatggagacaccgtcacacagtcacacggacacactggcatagtcacatggacggacacacagacatatggagaaatcacatggacacaccaccacactatcacagggacacagacacacggagacatcaccacatggacacactgtcacactaccacagggacacgagacatcaccacactgtcacatggacacaccatcacacacatgaacacaccgacacactgccatatggacactggcacacacactgccacactgtcacatggacacacctccacaccatcacaccaccacacacactgccatgtggacacaaggacacacagacactgtcacacagatacacanancnctgtcacacggagacatcaccatgcagatacaccaccacatggacttagcaccagacactctgccncacngattccccnccccncanaaatgcngaccncttgccacangcnactggccncgttttctancnggatcaggtgagcttgnntccnaaaaccangaaaaggagnggaagaag

SEQ ID NO: 22899 - DNA, 396 bp, Homo sapiens
  misc_feature 4, 33, 359, 365, 367, 371, 373, 377, 380, 381, 382, 383,386, 387, 388, 392: n = A,T,C or G
gggnatgtttccaaatttacttgattttcaagnacttacactagaactgtgagaacagggtaataaataagcatatgtattaatatcacctttggtcaactcttgggtagccccaacggtagtgtaggaattaacgtaatttttcctactaaaagtattggatttgttttgagagaccacagttgaaaatcattgacatacaaagtttaaaaattgttaggttaaaaaattttaaatgcatttgaagtggttttatagaaaaataattatctaacttggtttatattgacaggttgttttcttggataagaactagacgaagagaaaggggagatttagtgaataaatggtccccaggntttttnangttngnaaangtnnnnatnnngggntttt

SEQ ID NO: 22900 - DNA, 732 bp, Homo sapiens
  misc_feature 38, 610, 630, 641, 653, 657, 662, 663, 665, 672, 713, 714,727, 729: n = A,T,C or G
ggggtgacattgagtgatgttatttctcagtaagcagnatgtgcttattaaggtttctgcttatagcagcctgatagtattccatcatgctaactctctggctatattctactctaagctcaccttagtgattgattgcctcacgcagtgagtaaatacttactgtttttaaccacatttatgtaagtctgggttctcggaaataatgacactaaaaacaaatgagagaaattgcccgtgtatggatcctgatgctatctgtcttcagttcagctcagttcttttaaattagtagactccatgacagataccctgtgtattaactaatgcaggtagaaaactcatttctccttaatataatacattattttctagttatgataaacatgggccataaaaaaaattgagaagtcttgaaggtatttctttctagtgctaggtgtatatcccccagcactgcatccctgggaattcacttttctttgatactacaaagtcgtaaatggatacttggagaactgtactctagaataaattaaaatcatttagcttattttctattccattcccaggaactatgaagaaacaggattgttgaaagtgatgatgngggttggatttggatcatcntggggaaggtnttaaggaaacanttanagcanngntaaaagntggaccctaaaactactggtttgttattgggggaccctggnnaagttattaattntntgg

SEQ ID NO: 22901 - DNA, 544 bp, Homo sapiens
  misc_feature 6, 31, 39, 420, 424, 452, 470, 474, 477, 497, 499, 509, 510,516, 518, 524, 532, 533, 534, 538, 539: n = A,T,C or G
aggggnatatgggttagggattctccatggnactccagnaaaccctaaaatacaattttgaggttttccaataataccatagcagaaatgtccaaggggttgggggaagatattaccttgagaaaacagaaatgtaaaggatttttgaccttatatatgtgtgtggttttgtttttgtttttgttcttgagagagtctcactctgtcacccaggctggagtgcagtggcgtgacctctgctcgctgtaacctctgcctcctgggttcaggtgattcttctggcctcagcctcccaactagctgggactacaggtacaccacacccagctcatttttttgtatttttagtagagacaggagtttgagaccagcctggccagcatggtgaaaccccgtctctactaaaaatgcaaaaattanctangcgtggtggtgcatgcctgtaatcccanctacttggggaggctgangcanganaattgcctgaactcatgaancngaggttgcanngagccnanattgcnccactgcnnnctannctggg

SEQ ID NO: 22902 - DNA, 711 bp, Homo sapiens
  misc_feature 581, 675: n = A,T,C or G
tcgtaattttttacaattctagcatttttgacattgtcatcatctccaggttgcatctgaaaatacagctcctggaggactttctttttaccctgaactgtttctgtttgtactaggccacatcacatcagctacctgcaatgggcaaacacaaacactatcacttcccatctcaaaggcaacgtttcttttggggttgccatggaattcctgtttcctccaaaacaattcctctgtctttggttcgtgatggcatttggctgtgcatggccacacttctgcttgctctggccacccactctagcttcttttccagtttcttttgaatgacacctctcttaggtaaattctctgaaggagtgattttctatgcttccatcattatagttttacagttcaataatggcttcataagcagatacctgaccaatgtatctccagccatggtggtgggaggtgtggctcttcacattctcatttgccacctttggccccaccttgcttctgcacttgtgtctattattccacaaaacccaagccatgagagcctggagagtttctttttccagtggtaccaccangtctacccttactaatattttaatatttatggcattaaagccactaataaaaatatcatgacaaattcacttttaattttctcagatttatgangaacaccaaaaaagtgctatctctggactgcattgc

SEQ ID NO: 22903 - DNA, 743 bp, Homo sapiens
  misc_feature 1, 9, 573, 605, 739: n = A,T,C or G
nacgacagnaggggagaccaactcacagttgcaatttattttagcttatatatataattgaagctttttgcttgcctgcaggagtgtttcttaatcaatctaatcttaactaggggtctgcaagtaggaaagtttattagatttcttcctgaatggacgagtttaagaaaatccaggagctgtaacactcaccgcgaaaatctacagcttcactcctgagcccagcgagaccacgagcccaccgtcaggaatgaacaactccagacgcgctgccttaagagctgtaacgctcaccgcaaaggtctccagcttcactgctgagccagcgagactatgaacccaccagaaggaaaaaactccgaacacatctgaacatcagaagggacagactccagacgcgccaccttaagagctgtaactctcaccgcgagggtccgcggcttcattcttgaagtcagtgagaccaagagcccaccaattctggacacaatatattttggtattcctcatatttggtggattagaaaataagactagccttttataaatgatatgcctgaagatttgttttangatttaaatggtttctgggcactttgaggaangttggaaactgtagaaaaatttgtctttcttctagttcttggcaataagtctctttctctaaggagaagttacttaaaatattttgtgctgtacacctctttggaatttggctaaatctatggaactctatganaata

SEQ ID NO: 22904 - DNA, 692 bp, Homo sapiens
  misc_feature 573, 585, 638: n = A,T,C or G
ggggaatccttctccactgaaattacactctgtttacaggatgtgagtgaccagaacagcgtggactgtccccagctctacaaaccaggacagctgaatctgctttttaacaagcgtaaatttttcatttgcgtgttgcatggaatctacacctcattagtccttttcttcatcccctatggggccttttacaacgtggctggagaagatgggcaacatattgctgactaccagtcctttgcagttaccatggccacatctttggtcattgtggtcagtgtgcagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaangctcaaaagaangcaaggcctccaagtagccgaaggcctcggacccgcaggtcaagctcaagaangtctggatatgcttttgctcaccaagaaagctatggagagcttatcacatctgg

SEQ ID NO: 22905 - DNA, 287 bp, Homo sapiens
  misc_feature 3, 10, 11, 14, 18, 23, 26, 33, 36, 47, 51, 53, 62, 78, 80,82, 85, 215, 218, 220, 221, 227, 228, 229, 230, 232, 252,256, 257, 264, 265, 275, 276, 278, 283: n = A,T,C or G
ccnacttttnnaanttcnttcgntgnttttggnccnccccccttttnggantngtggtttanataacagtgcaatttngngnggntttataactttcttttgatcatcatgtacagaggtgttttttttctttaggcttctcatgcatatgaatattttaagcacgaatggactactaaatatctgagtttttttttttttttttttaaggatcntancnnaccttnnnntnccatttttggttttccaggngttnnttttttnntttttgtgtnntntcccnggcc

SEQ ID NO: 22906 - DNA, 706 bp, Homo sapiens
  misc_feature 695, 703: n = A,T,C or G
ttttttgaatgcgtgcatggctttttgagaaaacattttagtttcaagaattcctggagttgaggtatgacctccctccatttacctcttatctccaccttgaagacagtagctgtcacctctgaaagctgcagtagcgttttctgtttgtgtcaatgagtgggaactgaagagtagatacctctcattcctttaatgattccatttgcccaaaaaatgtttcggggtggggagtgcatatacagctcctgacttagggaagcacatatctttccactcagaatttcaaggggaaaatgttgatagtttttagcaaaggtgtgtccaaatctgaaagttggggtttgctttcattatttctttcttttctgtatttcttcacctatcttgatcaagaaaataaacagcttatatttttctaaatttcacacgatgtaataaaatttagaagtaaaagactaggaattctgacatggtctgtacgatggtctatacagggcattaaacaatgcccagggtcaacaaatgccatatttgcaatccaaacttctctctgcagtagctgccggtaatccaacctgcaactggagttaaaagcttcaaatgttactcaggaagacaaatgaataacaatgacacttctaatatgcatagtcaaatataacaaccaccaacaacaactaacccccctccanaaaagganggt

SEQ ID NO: 22907 - DNA, 721 bp, Homo sapiens
  misc_feature 458, 567, 606, 671, 720: n = A,T,C or G
aggggtgctagacttttatacaagtggcagctcagtacatttgtttacaccagcatcaccgcaaacaagtgagtaatgctacagcagcagaatggctacaatgtcactaggtgacaggactatttcagctccattgtgatctcgtaggaccactgttgtgtattcagttcattgactgaaacattgttctggggcacctgctgtattcccatgccccttataggatggtttgagatttgaatgagagtctagtgtttcaaacacaggaactaaaacataggctcatggagaaggctagttcctttctgctgcgatgctggagatgcagggaaatgggttggccgatatttgaatcagcacatgtctatacagggactgctatgcattcattcgtttagccagagtgtgtgtgaacacctactctgtgctggcagtgttggcagactacagtaaacaangcaagcccctcgtgggcctatgcatctctttggtagaatatgatctatgaaagtttagcatttggggaatacgaaccctggaggagtactgtgtgtgtacagattctangtcctgccacttagtagttgttagatcttggcatataangtaacttctttatgcctcaatttcctcatctcatctgtaaaatgggatgataaaaccttcataanattgttaagataatcaaatgagttgctatttgaaaaacatttagcacang

SEQ ID NO: 22908 - DNA, 673 bp, Homo sapiens
  misc_feature 552: n = A,T,C or G
catctaatggggtagaggtgggaggtggtcaggggaagcagggaagaaataacatttgagagctgagtcttccttgaagtgggaattaatcattcaaaatttactaagtccctattttatgccaggcattgggcaaggacccattggatatacagagatgactgacacagcatttagtttttcagaatctcatcggatagaggagacaatccaggctgagagcactatataaacaaaaggctggagtcctgaaaatgctttatgtgtttgcaggggatatagtttatgaaggaggggattaggcttaaaaagagctagacagtgaaaggtgaaagtagggaacagtggaaggtgatatggcctttaaactttgctgcttacaggtctttcaggttacagtttgaacttgatcctggaagcagcagagaaatcaatcactggctactcttaaaacagctgagtgacacaatcaaatgtgtacttcagaaattttccatgtggcaatgtggaggatgggctggattgccttgttattgggagacaaattagaangctactgcaatagtcctagcaagagatgatgacaggctgggcacggtggctgacacctgtaatcccaacactttgggaggctgaggtgggtagattgcttgaggccaggagttcagaccac

SEQ ID NO: 22909 - DNA, 409 bp, Homo sapiens
  misc_feature 16, 37, 54, 139, 211, 221, 225, 229, 235, 242, 276, 286,308, 323, 334, 340, 343, 344, 347, 348, 349, 353, 364, 370,389, 390, 396, 405: n = A,T,C or G
gggggactacgagggnatggcggcggctgcagcaggnaactgcaacatcccagnaggtttttccagagcttctcggatgccctaatcgacgaggacccccaggcggcgttagaggagctgactaaggctttggaacagnaaaccagatgatgccacagttatttattgtcaaagagcttattgggcccattcttctttgggaaattactgngttgctgttngctngatnccaaanaaaattnttttaaacctccattcccaattaaatttcccccngctttttctnggaaaaaaggagaatttttttngatttcccccttggnaaaaaaaaatnttttcnttnnttnnncccntttaaaaaaantttttncccgggggggggcccaaanntttttnttttttgcnccca

SEQ ID NO: 22910 - DNA, 448 bp, Homo sapiens
  misc_feature 402, 403, 409, 418, 423, 426, 428, 431, 432, 433, 434, 436,437, 444, 445, 446, 447: n = A,T,C or G
gtaatcatttctgggccacttggtctcatatctgttccaccagtggtagccatcacgttttgcattgctctcctggcatgttcactatcaggatctttcactttcagtggtcttccactcagactatgcttgtctagcacctgaatagctttttttatgttttcttccatcttgaattcaataacagcacatcccctgactttccttcagtgcctgttgcccaggctgtattgcagtggcatgatctcggctcactgcaaattttgcctccctgcctcccgggttcaagtgattcttgagcctcagcctcccaggtagctgggattacaggtgggcaccaccatgcctggctaatttttttgtattgttagtagagacagggttacccctttttttgggccnngctggncttgaaatnctganctnangcnnnncnnccacctnnnnt

SEQ ID NO: 22911 - DNA, 596 bp, Homo sapiens
  misc_feature 50, 69, 70, 73, 74, 85, 86, 115, 122, 126, 132, 133, 141,142, 143, 144, 145, 146, 147, 148, 149, 157, 161, 175, 191,193, 203, 205, 211, 218, 224, 225, 227, 242, 264, 297, 299,302, 316, 326, 327, 328, 329, 330, 331, 332, 333, 334: n = A,T,C or G
  misc_feature 335, 341, 342, 343, 344, 346, 348, 352, 373, 374, 378, 390,391, 405, 408, 416, 418, 436, 439, 442, 458, 483, 484, 485,486, 487, 488, 489, 498, 503, 508, 519, 539, 546, 547, 553,576, 584: n = A,T,C or G
aggaagtggttggagtagagagtagtgtggaatgaccaaaggtggggttnccctttttttttttttttnnaannaaattaatttnntttggggccccccccccccccctttattnatttttnttgngggggnntttttttnnnnnnnnnaaaaaaanaccntttacccttttttnaatttaaaaaaaagananaaaggggggnancccccnggggggnaaaaanngnaaagggggaaaaaanccccctttttttttttgggggnttgggtttcccccttggggcccccccctttaananatnttttttttttaaantttttttttnnnnnnnnnnaaaaannnnananaaanaaaaaaaatttttttttgggnnaagnggggaaaaaaannttttttttttttanaancccccccncncccaaaaaaacccccccnttnttnttttttttccccgggntttccccccccccttttttttccgnnnnnnnatataatanaaaanacccnttttttttttnccccccctttttttttgggngcccccnngagggnccctttttttccccccccccccntttttttnaaaaaattattt

SEQ ID NO: 22912 - DNA, 798 bp, Homo sapiens
  misc_feature 2, 3, 14, 18, 19, 27, 30, 41, 43, 63, 71, 76, 619, 627, 635,637, 645, 649, 653, 707, 718, 719, 722, 725, 727, 731, 732,733, 737, 745, 749, 764, 765, 774: n = A,T,C or G
annacttggttcgntaanncttgcttnttncttttggccgnancggcctactgctgcgatagnacgacagnagggnatactatgtttcgtctacagttggtaaatttttgtttttctttgtattaaatgttgaattgtattgtctggaggaaaagacagaggtctaaaaataaagaaggagtacagtttgggcatggtggttcacccctggagtcctagcactttgggggccaaggcaggcagattgcttgagcccaggagttctagatgagcctgggcaacatagtgagaccccatctctaaaaaaacagttttagggccaggcacagtggctcacacctgtaagcccagcactttgggaggccgaggcaggcagatcataagggcaagagattgagaccatcctggccaacatgatgaaaccctgtctctactaaaaatacaaaaaaattagctgggcgtggtggcacgcacctgtagtcccagctactggggaggctgaggcaggagaatcacttgaacctgggaggcagaggttgcagtgagccaagattgccccactgcactccagcctggtgacagagcaagactctgcctcaaaaaaaaaaaaaaaaaattntttttgtnttacctgngngggggggncatncctntggccccaccttctcaggaggctgaaatgggaaaaccccttaaccccaaaaggncaaggctgcannaantcntnatcnnncccnttcctttncccngggcaaaaaattgannccctgtctnaaaaaaaaaaaaaaaaaaaacccc

SEQ ID NO: 22913 - DNA, 411 bp, Homo sapiens
  misc_feature 31, 147, 150, 191, 206, 229, 231, 251, 254, 266, 275, 304,306, 320, 321, 328, 350, 366, 377, 389, 395, 396, 399, 400,404, 405, 408: n = A,T,C or G
gggatgcctcccaggtccaaacccagccagnaaaggagagtgagagtgctgagtgcaaaactctcctatagctcctatacaagtccaggatttgctattagactccttgaattatgtgcccagctctgagccaatggctgtgcttangangctcctgtctcatgcaccccaccccagtactggggcatcanaaacaaccagtgatnccttttatgaaccacgggttcananacttaaatgtaatcctgcancanggccttaggaanacttggaancccaaattcaaaaagccctgggtttcttngncttcccggggggcnngttttgncccccttccccttttggaaaangaaacccctttttttnatttggggggnaaaaggggggtncccctnnaanncccnnggnttt

SEQ ID NO: 22914 - DNA, 695 bp, Homo sapiens
  misc_feature 533, 606, 641, 646, 684: n = A,T,C or G
ggggacatgaatcattgctatggctgtagctagtgcactacaatttcctaaaaagtcttgtcactctcataggactgctctacatctggcctctgccaatgggaattcaggagtagtaaaactcctgctggacagacgatgtcaacttaatgtccttgacaacaaaaagaggacagctctgacaaaggtatgcagtagccaactatatcagcatgaggccgtacaatgccaggaagatgaatgtgcgttaatgttgctggaacatggcactgatccaaacattccagatgagtatggaaataccactctacactacgctatctacaatgaagataaattaatggccaaagcactgctcttatacggtgctgatatcgaatcaaaaaacaagcatggcctcacaccactgctacttggtgtacatgagcaaaaacagcaagtggtgaaatttttaatcaagaaaaaagcgaatttaaatgcgctggatagatatggaagaactgctctcatacttgctgtatgttgtggatcancaagtatagtcagccttctacttgagcaaaatattgatgtatcttctcaagatctatctggacagacggccanagagtatgctgtttctagtcatcatcatgtaattngccantactttctgactacaagaaaacagatgctaaaaatctnttctgaaaaca

SEQ ID NO: 22915 - DNA, 736 bp, Homo sapiens
  misc_feature 1, 8, 18, 21, 30, 127, 133, 135, 137, 144, 147, 150, 157,162, 166, 171, 172, 175, 179, 189, 197, 198, 200, 208, 210,212, 215, 217, 221, 223, 225, 233, 235, 237, 242, 246, 250,251, 261, 264, 265, 266, 270, 279, 280, 285, 287, 288: n = A,T,C or G
  misc_feature 294, 298, 303, 304, 307, 312, 317, 318, 325, 327, 351, 354,356, 360, 366, 370, 372, 378, 385, 386, 388, 389, 395, 397,400, 404, 406, 412, 415, 423, 427, 434, 436, 437, 445, 446,448, 451, 455, 459, 465, 467, 473, 481, 492, 496, 498: n = A,T,C or G
  misc_feature 503, 509, 535, 536, 538, 541, 542, 563, 584, 606, 615, 621,667, 670, 677, 683, 687, 699, 704, 706, 717, 727, 735: n = A,T,C or G
ncggcctncggctgcganagnacgaccgangggtctagtgcagtgtagaacccttttctcaggcaaaacctaacatctgaccgcaccctttttgctattaaaaaaaaaaaaaagctttttttttttncctccngncnttaaaanaanttntccagtnaacancctntcccnntanttgngttttaccancgtttttnntnttgagagntngnccncngggntntnaacggggngngnaaggnaccntgtnncagggctggnttnnnaaangggcctttnnggttngnnaaaaantttntgggnnctnagggnggaanntttttgntntgcaaaaaacccaaaaaacttttnggncntccntaaaanttcntnaaaaanctttttnntnntgaccngnaanggtngnaaaaanaantttttttnggtnaaaaaananncttttttnntnggngttnaaanaatttntncccctngttaaatntacatggaatngatntngcttnttctgnctaagggaaaagggttatttctactnncngcnnatttagaaacatgtagggttnaattgccagttggaatttttnttccatacttttacagtttatnttttactanaggcanaattcccctttttatcctaaatttggattttctccataattacatnggnccttggncttggntggntataattccttnacctnangaaggcaattntggggcattngggggggnt

SEQ ID NO: 22916 - DNA, 740 bp, Homo sapiens
  misc_feature 2, 9, 15, 56, 572, 617, 633: n = A,T,C or G
gnatacagnaagggnatgagtgactccatgttcaagctctccttttgcccagtggnatggaggtctcgaattaacatcaggctgtcagttgggtgcctcttacctctccagaatcctgagctctcctttcagttcaaacggtatcatctggactggaaagacaaaggtcatttccatcatcgcgattgcattatcttattgatctagaaaagcaggttaatttcttcttcatccttcttgctctgagtataaatttaaacattatttctggctgggcgcagtggtcatgcctgtaatgccagcattttgaggggccgatgctggtggatcatttgagcccagtagttcaagaccagcttggccaacatagtgagaccccatctctacaaaaagtacaaaagattggctcagtgtggtggtgtgcgctggtagtcccagctactggggaggctgaggtgagacgattgcttgagcccaggaggtcaggctgcagtgagccatgactgtgccactgcactctagcctgggcaacaaagcaagacactgtctcaaaaataaataaaatatgccangcacggtggctcacagctgtaatcccagcactttgggaggctgangctggcagatcacgangtcaggagatcgagaccatcctggctaacatggtgaaaccctgtctctgctaaaaaatacaaaaaaaattagctgggcgtggtggtgggcacctgcagtcccagctc

SEQ ID NO: 22917 - DNA, 794 bp, Homo sapiens
  misc_feature 2, 4, 10, 12, 17, 21, 22, 29, 34, 47, 48, 61, 75, 78, 97,112, 116, 118, 168, 175, 180, 188, 236, 376, 431, 435, 441,446, 448, 450, 457, 459, 463, 472, 478, 487, 489, 491, 496,499, 506, 516, 529, 536, 573, 581, 586, 607, 608, 652: n = A,T,C or G
  misc_feature 658, 661, 667, 685, 688, 695, 701, 738, 746, 769, 789: n = A,T,C or G
antnaaactngnttcgntaanncttgctncgttncttttggccgcanncgagtacgacagnaagggggaccgtgnganttgaaacctcagaatacanatacaatttgagtantaangnaaaggtaaggagcaatgacacaaaaagcacccagaggagagtatttctgngtaaacnggtanattaatangtggatatttaatacacaaattcacatttgtttcaagattggccttgngtgtatggatactaaaaaggaaataacactaatgcttcattcatttttttattccaaataattttgctaagccccattacatagccaactcactgttagacactttgttttaaaggtgaaagagttaatacatttgcttncaaagaacttactagtaaagttacacacacacacacacacacactcacacacacncacntacacncacananantgatgananaganttacttatnctatangaaataaangntntatanaanatctaanctaccgttcnactgtagattttntaaaaangaggtcttatacttatacaatggtgagtgataaaaanagaacatnttcanatagtgagtctaaaatgaatnntgcaggttgtccgggtgtggaggctcacgcctggaatcccatcnctttgngangctgangcgggcggatcacgaagncangggatcnagaccntcctggctaatacagtgaaaccccctctctactaaantagaaaanttaggcaggcgtgggggcgggcnccctgtattcccagctactnaggag

SEQ ID NO: 22918 - DNA, 686 bp, Homo sapiens
  misc_feature 533, 551, 584, 629: n = A,T,C or G
gggaaggaaggcttgggaagaacagttgtggagaaaatggatacactgagtaaaatagagataatttctttgaaaatggatttacatgtctcccttttaggatttaattttgtaaagtgaagtaaatatggaatggaaattaaaactttataaaaatattcaagtataaattttagaaaagtattcaacataaaccttatatttttagatggaggctataaaaagtttattcagttatgccatctataaaagttattataaatatgcagatattaaaattagtgggaaagtttctatattattgaaaaaagaatgttcatctaaatcgactgttctgagtgagttaaatattctagggattaaagatgtatatatcagtgttctttaggtgtggctttacagtgatcagcatctcgtttttgatcctcgttgcaggaatttgtgccaatgtgttgaggaagtaacttaagataaagcttgcaggctgagcgtggtggcttacgcctgtaatcccagcactttgggaggctgangtgggcggatcacctgangccaggagtttgtgaccagcctggccaacatanggaacctcttctctcctaaaagtacaaaattagcctggcatgggnggtgcacacctataatcccagctgttctcatggctgagacataagaatcacttggga

SEQ ID NO: 22919 - DNA, 272 bp, Homo sapiens
  misc_feature 159, 176, 177, 181, 191, 203, 213, 220, 231, 234, 235, 241,250, 253, 255, 261, 270: n = A,T,C or G
gggataacaagcacattgtcgatttcgtgagtattattgcttaagatcgggttaagtaataagtaaaccaattgaatattttatttcagttgaaaagaaaaatactgaagaaatttttaatgcctttaatggggtacttgagtatggcaaaaatcgggnaaggctgaaaagtgtcnntttngggaagcctngggtccccaagntccctccggnggggccnttttaattcanccnntttccnaaaattttncgnanctcccnccctggagngg

SEQ ID NO: 22920 - DNA, 771 bp, Homo sapiens
  misc_feature 2, 8, 12, 15, 19, 20, 32, 44, 46, 47, 58, 61, 82, 405, 677: n = A,T,C or G
anaaactnggtncgntaanncttgctttgttncttttggcacgnannagtacgacagnaangggacacaaaagcacccaggngagagtatttctgtgtaaacaggtaaattaataggtggatatttaatacacaaattcacatttgtttcaagattggccttgtgtgtatggatactaaaaaggaaataacactaatgcttcattcatttttttattccaaataattttgctaagccccattacatagccaactcactgttagacactttgttttaaaggtgaaagagttaatacatttgcttccaaagaacttactagtaaagttacacacacacacacacacacactcacacacacacacatacacacacagagaatgagagagagaattacgtattctatangaaataaaggtaatatagaaaatctaaactaacaaattgtgccaagctctttctctgctatttcctgaagttcaacaccctgcgggtcagcccccgagggccatccagcctccatcttccaagaccaattttacctcgtgtctccaatgacaaggggaaaattttggcattccttggagacttaacaggatgcagtgaagttaggcacttccaagagctgacccatcagtccgctcttattcatccccaaagggatgtatggtggtattatngaagacctttactagacactctgccaaataattagagcagtacttatgccctagttcaattggctatcccttctaccctggcatttcatcaacc

SEQ ID NO: 22921 - DNA, 676 bp, Homo sapiens
  misc_feature 178, 179, 214, 307, 345, 440, 464, 472, 500, 531, 542, 573,588, 609, 616, 618, 625, 634, 644, 649, 662, 668, 669: n = A,T,C or G
gggggaaaattctgttaattatactgcccttcccctttataggttttctgtaggagttaaaatacactttttcaattgcttgacataatgctcaacactggtaggggagctaaaaatgtcagctattgtcctatgtgccaaaaaaaaaaccacacagacagacacacacacacacacnngggacacacatggagggagaggaagtaaagattanaaagcagcacatagtgtatcggtaggcaatgggaccactagtgattttcatattcttttttattttcttctttatactgcttacattttcagngttatataatgagcatgtattacttctgtaatcagaanaaggtggtataaacctgaccttaatataataaaacaaaattactggccaggcacggtgtctcatgcctgcaatcctagcactttggaaggctganactggtgaatctcttgagctcaanaatttganaccagcctgagctcagtgagacagtganacctcgtctctggaaaaaatacaaaaattanccaatgatggnggtatacacctgtagtcctaagttacctggnaggctgaggtggganggtggcttgaccccaggaagngctgcantnagctgtnactgccccnctgcactttnacctnggggaaaaaccanacccannctcatac

SEQ ID NO: 22922 - DNA, 626 bp, Homo sapiens
  misc_feature 378, 577, 623: n = A,T,C or G
agtttaggtggtaatcatggaaaaaggatctgtatgccatcggaatttaataggtgtgtatttaatagattaataggaaaggaacataatcagatgcttccggttagcaagagctgtccccactcacccacgtgtggcctccttcagccagaaccggttctccttggcagggaatctttctctaggagcagagtggttctcatttaaaagtaggggtgaccggtctcttcctttttttggaggctacctttcttcttggtttgggatgtacatccctgggcaaaatttagagtagatctcttggcaagatttaaagtggagatgagttatttagtgttcttttggtcaaaaggggtcatgggaggactgctagactangggtgctctgtgacctctagctccagccaccttcccacgggcaaggagttttaccccgcctttatgcatgggtcttttttaatttatacccttcgataccatcagcagaaatcttcccaattttcatttcaaagtataccttcaccccagttaaggctttaaatactggtcctaaattaaaagcagaaaattgcagaanctttaacataaaaatgtgtgaacccaaacacccacctgccaattanagt

SEQ ID NO: 22923 - DNA, 706 bp, Homo sapiens
  misc_feature 4, 14, 15, 581, 657, 664, 674, 676, 681, 687, 695: n = A,T,C or G
gggnatttcttagnncagcacttctcattctgtggaaggagaagaaggtatcagtcacatagagggttttttcgcaataactcattacctggctctaaactagagctgtgtaatcagaatgggggaggagctgagagtaagagaacagatggagaatgggttggcattttgaaacagcttcaccagataaacttgaaatctcccagatttagaaccattcttttagattatctagcaagactggccaacattgttcggaaatctaacattgagatggtaatggcccaggcacggtggttcacgcctgtgatcccaacactttgggaggccaaggcaggcagatcacctcaggtcaggagttcgagaccagcctggccaacatctctactaaaaatacaaaaattagccgggtgtggtggcaggtgcctgtagtcccagctacacagaaggctgaggcaggaaaatcgcttgaacccatggggcggagcaggttgcagtgagccgagatggcatgactacactccagcctgggcaacagagcaagactatgtctcaaaaaagaaaaaaagatggtaatgcanctaccaactctcctggatgattttgatcacgaggagaaatcttggtcctccctcatgtgaaaggtcctgaaatagnctaccgntgctcttttntnaatgnattcanagtaaccntgaccaggaat

SEQ ID NO: 22924 - DNA, 552 bp, Homo sapiens
  misc_feature 20, 21, 27, 28, 48, 59, 63, 74, 85, 87, 90, 96, 125, 140,145, 193, 279, 303, 394, 401, 444, 454, 468, 481, 500, 505,511, 522, 527, 528, 530, 533, 534, 536, 539, 540, 544, 551: n = A,T,C or G
gtgttttaagagaagtttannaacgtnngtcgataaaaacctgttttnttgcttttggnccgnaagcggctctnacggtctgcgnanaanagacantaagggaatttttgttataggaaaaacantttttaaatcactgnatagnacccagacttttcactgtagaaatgggaggttgcaggaaaacaagggnaaaggggctacaataatctatgtagcaatagatgagagttggagtcataaatataaactcatagttggcttaatatagatgcaggngggggggataaaaaccattacagnatacacaacacacacacacagatatagataagtatacatccatgtaatgtcattgctctgtcagggattagaagcaatgataactcagtancaaccancatatctggcacccagatctttgtttgtagtaccattctccantaaaacaaangctgcttggagaantggctgattctangactgggataggacagatncaccntatgancctgcagcatnttgtnngnccnngnagnntttntactccnt

SEQ ID NO: 22925 - DNA, 665 bp, Homo sapiens
  misc_feature 476, 494, 497, 511, 513, 543, 564, 587, 589, 608, 614, 615,617, 618, 625, 630, 631, 634, 637, 640, 647, 659: n = A,T,C or G
gggtctctggaggatctccgcgcgtggcgagtctgtgtcttccctgtcccccagagcagacaccctctctgtgtctggaccggggaggagcagacgctggacagggtgtgtgtgttcagcagtggattgtcagacttggggtcccggctgctcccctttgggtctctccccgggcccgctgatctgactgtaattccttctgctggagctatggttcggccaccttgacgcgccccctctgcccctggagcgtgtctttgggttttgtgcgtgtgggagtggggtgtatgtgtgtttcttatccgagacacctccgggtcgtttgcttggaaaccggctgagggcccgcataccctggagcatttggttgcaaagtgaggcatgtagcgcccaaagctcctgtaccagggccaggttaggcaccaacgcgtcccttatgtctctgcagcctgcagtgtggtggaaccgtttcatanactgaagtgtgaacgtangangggatggatatcananatctgtttatccacattttcagagagtggnattgctctgatgtgagcgtangcaggttactctctgtgtctcgngntctttacctgtaatttganggttgnngnncctactnttaannggnggntgngaggatnaatggaattttnacatgc

SEQ ID NO: 22926 - DNA, 662 bp, Homo sapiens
  misc_feature 1, 9, 565, 581, 584, 598, 607, 612, 627, 643, 655, 656, 657,658, 659: n = A,T,C or G
nacgacagnaggggaatcaggaaacaaatcaacaatcaactggaattacaaccaaatctatgtacttctgttgtgagatctttttacttgcaatcctttgcaaaacgtgctgtgcacaatgtagtaagtatgcttgtaataaacaattaaaggagcttttcacgtgtagaagtgcacgcttaatttttgttaaatcatctcaataaatacttataagtgaagccaacatgattttcttaagttttttgaaaatgtgtgtacctataactgctgtgctatttgcaagaggcagtatacacacaaatttgatgatttcattctttaccaaatactatatttagcacattaaatactaagaaatagcactaaaatgggccgggcctggtggctcatgcctgtaatcccagcactttgggaggccgtggcagacggatcacttgaggtccagagtttgagaccaacctggccaacatggtgaaaccccgtctctactaaaaatacaaaaattgctgggcctggtggtggatgcctgtaatcccagctactcgagaagcttgggcagganaatcacttgaactcangangcgggaggttgcantgagctganattgnaccactgcactccancctgggcataaaagcnaaactcccctcnnnnnaaa

SEQ ID NO: 22927 - DNA, 665 bp, Homo sapiens
  misc_feature 480, 505, 545, 566, 572, 588, 593, 594, 608, 612, 617, 619,633, 634, 637, 648, 649, 650, 651, 661: n = A,T,C or G
ggggtttagctgataggtctgtgaaactgccctcaaatttggagccaactcattttatttggtgtagtagctcatataatagttaccttttattgagtacttactatgtaccaaccattatgtgccagacactgttccaaacactgtgttaaaccacttcatggaacattcaaaactcagaggctacactggctggatttaagtggtgggggttatacagcaaattacctacatttaaggttgctgctgccgtttcattccatgttgccaactgcagaaatgtgggctccgtgttcccagactttccatttagtcaaaagagacaggaaattcacatttttatggatatttcctgattttttaaacactacaggctaactgaaacagtttgtgacttttgcattgtatgttccactccattttatcctcataacatccctacaagataggtataattatttgtattttgcgcactctcancacagctaatacagagcaaaagtanaaatctactgcaggtctgtctccctccaaaactatgttgntattgcgcttcctcatctggntccctnaactcatgaaggtggnactgnnggcaaaaaaatgtnctgnttggntnaagccaggcccttnncanattttcaaacnnnntggtgctggnccca

SEQ ID NO: 22928 - DNA, 659 bp, Homo sapiens
  misc_feature 49, 63, 66, 105, 121, 169, 177, 190, 198, 201, 211, 213,218, 246, 263, 269, 290, 305, 309, 312, 347, 349, 362, 375,380, 426, 436, 450, 460, 470, 483, 515, 522, 536, 592, 593,599, 609, 620, 623, 640, 655, 658, 659: n = A,T,C or G
atgctttagcctaaaatactttgcatgcttaggagagaaaaaaaaaaancaaaaccccctganttntaaggcctgcaggtaaatttaaacaacaggctttggagncaaaccaaagtttgcnttgcaaaattttcacttttgctgggtaacttctgccgtataacttttnaacttgancctcactgagttntggggganaanaatactcatntntatgnggggttaataccccattaggaacattgngaggattaatgcagttncatgcnttacattacataaagtactcnccccaaaacttaccntgtntanatgccagtaaacaaaatctactgttaattataatngncattctaaaaatnaattttgccaggngcggnggctcacccctgtaatcccaacattttgggaggccaaggcgggcanataacctaanaccgggagttcganaccagcctanccaacatggngaaaccccgtctntactaaaaatacaaaaattaactgggcgtggnggcaggngcctttaatcccanctactcaggagtctgaggcaggaaaatccctcaaatcctggaggcaaaggttgcanngagctnaaattgtccnctgccctccanccnggcaacaaaaaaaactntgcctcaaaataaanttnn

SEQ ID NO: 22929 - DNA, 712 bp, Homo sapiens
  misc_feature 2, 3, 4, 13, 16, 20, 21, 32, 43, 45, 52, 62, 65, 72, 503,559, 576, 577, 629, 631, 651, 653, 657, 662, 666, 676, 680,682, 685, 687, 699, 708, 710: n = A,T,C or G
annnacttgggtncgntaanncttgcttgttncttttggccgnancggcctncggctgcganagncgacagnagggggaacttagtttagtaggtgagaaagtcttgaatgtgaatagctgaacaagtaatacaagttggcagtattttatgggtgttacaagtgatgacttaggttcgaaggaataagcagttatttctagctggaggaatcagaaggcttcatggatgtaggacttgaaaggcatcttatggacatattagtagaagatgtactaattggagcaaacaacactgggaaagtcctgatgatttaaagcttctctgatgtatcttaattttattacataaccgatgtttaacaagtgattggattattaatattaccattttttggtcttaaaaagaatattgttgtgttagatgattcagcatagtattgtagttctcaaagtgtgatccttggcagcatcaacatctcctgctaacttgttggaaatgcanattcttggctgaatcccatatctagccgttgagtcagaaagtggtgtgggattcancaccctgtgctttaacnngtcttattttgacagagccacttctacttaatgactacctttttaaaatgcngnaactgatgctcactttggcncncatntgttnaaantggaatgatncaanantancntgtcccctgccnaggatgacncnca

SEQ ID NO: 22930 - DNA, 741 bp, Homo sapiens
  misc_feature 1, 9, 584, 642, 654, 673, 683, 686, 699: n = A,T,C or G
nacgacagnagggattccttcaggcccgttcctcttattaaaaaatgataataatctttggaaattggtcattgggatatttgcattccatcttatttttgatatttttctgtctaatttctaattgtttatattgacaggttacatgctcatttagataatttggataatgaagaaaaatgaagtttaaaaatcaactcaaatcccaccatctggaaaaaaaactaacaaacatgaattgagcttcatttcagagatgacagtgtctcactttttttacctctctctttctgtttctttggtttcatcgaatttggagcctctcttgagctttgatgtcttttaagatgcccactctgtttgctcttatagatcattcgttctttctatttgagtccctaaagtattattgggatttctgaagcttaaccaaaatatgtctcagtattatgcatttcctgaaacatggagtgttctttcagtctgcgtatcagtttgttctagctcagggaattttttttttaaaaaagattaagtttggctgggagcagtggctcactcctgtaatcccggcactttgggangctgaggcgggtggatcacctgaggtcaggagttcaagaccagcctggccaacacggngaaccccatctntactaaaaaacaaaattanccggcatggnggngggcgcctgtatncccctgctcaggaggctgaggcaggaaaatgcttgacccagg

SEQ ID NO: 22931 - DNA, 778 bp, Homo sapiens
  misc_feature 4, 11, 14, 18, 19, 30, 41, 43, 50, 60, 63, 70, 95, 595, 617,680, 683, 726, 764, 765, 769, 771, 772: n = A,T,C or G
attntttggtncgntaanncttgcttgttncttttggccgnancggcctncggctgcganagncgacagnaggggttgcctatggggtatgaagnatgaaggggagctggtgactgagactgggtaggagcagtcagagaggtaggagacagaacaggagggggtggagtgaaggaaaggaagaaaagtaagggcttaagaaggacttggccattctttacacaaacaaggcagacaaattcagagcagagacctgggatagtgatgagtgggtttcttagtgaccatagtgagagtggttcattggcttggtgaggacagatgcttatttatggggctcaggaagaatgggaagaaagacgtggattttataaatgtgtgctattcccttaagcagattggcaataaaaggaaggaaaactttgaaagaaacagggtaaagaaatgatctgtctccaaaagaggcaattgtcttggtcatccaggaggtaaaggcaaaggcttgaagatgcaggaaatggtggggacgatggagagagctggcagggatagaatcaggagcatggctggagggattggtctcaggaagaaatanagacactgcttcaagattgganggaaggctgggcacagtgggtggctcatgcctgtagtcccagcaattttggaggctgaagtangangattgcttgagtccaggagttcaagatcacctgggcaacatantaagatccccatcttgcaaaaaaaaaaaaaaaaacccnngggncnntttttt

SEQ ID NO: 22932 - DNA, 739 bp, Homo sapiens
  misc_feature 36, 528, 610, 633, 636, 675, 688, 716, 738: n = A,T,C or G
gggttagacgtgagtcagtatgactgtgcacacagnaaaaaatctcttagacgtaagtcagtatgaccgtgcacatagaaaaaatctcttagatgtgagtcagtatgactgtgcacacagaaaatctcttagacgtgagtcagtatgactgtgcacacagaaaatctcttagacgtgagtcagtatgactgtgcacacagaaaatctcttagacatgagtcagtatgactgtgcacatagaaaatctcttagacgtgagttagtatgactctgcacatagaaaaaatctcttagatgtgagtcagtatgactgtgcacacagaaaatctcttagacgtgagtcagtatgactgtgcacacagaaaatctcttagacgtgagtcagtatgactgtgcacacagaaaatctcagatatgagtcagtatgactggacatagaaaatctcttagacgtgagtcagtatgactgtgcacatagaaaatctcttagatatgagtcagtatgactggacatagaaaatctcttanacatgagtcagtatgactgtgtacatagaaaaaatctcttagacgtgagccagtatgactgtgcacacagaaaatctcttanatatgagtcagtatgactggacntanaaaatctcttaaacgtgagtcagtatgactgtgcacacngaaagtctcttanatgtgagtcagtatgactgggcccatanaaatcttttaaacgtgatgaant

SEQ ID NO: 22933 - DNA, 671 bp, Homo sapiens
  misc_feature 6, 34, 643, 667: n = A,T,C or G
gacagnagggggcacgtgggcttcttcctgcggntgaacacattcatggcagaggtgtgtggacatacgtgcatacacgcatgcagttttcagtgaaaaccgggtatcaaacccacagcttaccaaacccaaagtgtggtgttgtaagggaggtggcctatatgattttgtggtcttcatataaataatccttaagagtccataaagagaagggaggagttaacattgactgaggtattgctataatacctgcatctttgcattaaagaaagggaggcataaagagatcttgcccgatgtcaacctagtgagtcactgatggaataggcttggatcccacagtttattctactgcaccaggctgtagttgaggtacagtgttgataggtggtcccgatggtgtatgtttgtttgtttgtttgtttttgagatggagtcttgccctgtcacccaggctggagtacagtggtgcgatcttggctcactgcaacctctgcttcccatgctcaagtgatcctcccaccttagccttccgagtagttgggaccacaggcgcacaccaccatgcccagctgttttttgtttgtttatttgttttgagatggcattttcgctctcattgcccaagctggagtgcaatggngcgttctcggcttactgcaacctncacc

SEQ ID NO: 22934 - DNA, 761 bp, Homo sapiens
  misc_feature 11, 14, 18, 19, 30, 41, 43, 50, 60, 63, 84, 624, 689, 706,726, 737, 740, 750: n = A,T,C or G
attcttgggtncgntaanncttgcttgttncttttggccgnancggcctncggctgcganagncgacgaagggccgtttttagnatagtttttccccattatctgtaggaactataaataaaagacagttaaaaaaacttttagaacttttgcttttgtaaaaaaccagaagtctttcatctgatgatgagacatttaagttggcattagaaaattttgtaatactttatgtaaccaattacagatttttttggacactgagattctgcttctgtaggtactgtttaccgacagtaaaatataaattcttagatctagatatcaaaaattatttaagttgagattactatttttgcacagcaaattcaactttgcaaaaatgaatttgaaaggaaaaactttaagaaatttcttgtcaatttgtagatgtcagattctcattacaaaattattataatattctaatttttaaaaattaggtttatttcactccttattgtccctcagggggcgataatgagggtaaaatgagataaatatagatatactttcaaaaatgttatacacactcaaattataaatgagttgagcaccgggcacagtggctcacacctgtaatcccancactttgggaggccgaggcgggtggatcacctgaggtcaggagttcgagactagcctgaccaacntggagaaaccccatctntactaaaaatacaaaattanccgggtgtggnggngcatgcctgnatcccgctact

SEQ ID NO: 22935 - DNA, 602 bp, Homo sapiens
  misc_feature 502, 513, 520, 553, 558, 577, 582, 591: n = A,T,C or G
ggggagggctcttccggcgccttcccaggcggggatgctgcggctccgcagcgggctgaggcaccttcgggcaacacccaatactcggggctccgctcggcttcttcgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagggtggtaaatctcgtgaaaaggtggtgaagcttttggcttctacaactccagaagagatcttggagaaattaaaaaggaagccaaaaaaacataaaagcaanaaatgaggccnggcgcantggctcatgcctgtaatcccagcactttgggangccgnggtgggcggatcacctgangtcangagttcaanaacaaccctga

SEQ ID NO: 22936 - DNA, 716 bp, Homo sapiens
  misc_feature 592, 640, 647, 657, 687, 691, 696, 697, 698, 712: n = A,T,C or G
gggaccaacttgcgagtctaaaaccaaaaagagtttcttgagcctcatgagaatcatggtccaaaagtgttttccagatgtttccatatgttgtacgtagtaataattacaagatgctacctacgtaccttatacattccccaaattttacatctggtatttcacttctactatttgtacttctttgtccacttgctctgtgactgacagatggggctcagcttgattccagagctggcacttgacccgaggtcttctctgcctggcacagtgatacatggtgtagcgtatccatgtatgttgtctctgtgtgtgtttctcatactttcctagtgggctgaagagctcactaacttcttgtttccacttggcatgagtatagatttgacacctgccagtctcatttttcttctgccagcctagagctcccagtttttgactttgagtctcttgataggaattgcattttttattccacattttttggtgtctctgggactagagtataggagttttttccagaaaaaaactgattaaatctccctactgacattcacctgagctgtatgactctgtctcggtaagacatcanattttggggggttaggatcttttgaatcctgactggaaaatattctanacttganatctgtcagngtctcatccacctttatccttggtcttagncagnctgcnnnccatgtatcataancatt

SEQ ID NO: 22937 - DNA, 666 bp, Homo sapiens
  misc_feature 17, 54, 472, 538, 553, 570, 592, 608, 635, 650, 653, 656: n = A,T,C or G
ggggaagcctggccagnacctggaagaacaaagtagcatcatctctctgacagnagtagtttgtgttcaaagaacctcagcaggtagtacgtagagctcctgagccacgagtgattgacagagagggtgtgtatgaaatcagcctgtcacccacaggtgtatctagggtctgtttgtatcctggctttgttgacgtgaaagaagctgactggatattggaacagctttgtcaagatgttccctggaaacagaggaccggcatcagagaggatataacttatcagcaaccaagacttacagcatggtatggagaacttccttacacttattcaagaatcactatggaaccaaatcctcactggcgccctgtgctgcgcacactaaagaaccgcattgaagagaacactggccacaccttcaactccttactctgcaatctttatcgcaatgagaaggacagcgtggactggcncagtgatgatgaaccctcactagggaggtgccccattattgcttcactaagttttggtgccacacncacatttgagatganaaagaagccaccaccanaagagaatggagagtacacatntgtggaaagagtgaanatacccttggatcatgggaccttgttnatcatggaaggagcnacncangctgactggc

SEQ ID NO: 22938 - DNA, 732 bp, Homo sapiens
  misc_feature 191, 315, 375, 390, 457, 483, 487, 496, 537, 552, 580, 621,624, 676, 682, 683, 700: n = A,T,C or G
gggggaaaaatggtgctgatagacttgctcaaccagggttgccacaaacctgtgatgtgtaacaaaacacagtatccgcaaagtgcaataaaacagataagggctggaggctctggagttgaaagccctctacatggcagatgatcattgaagacatgtgatgtatgcagtcactaagagagaagctgtanaagaaaaagctgagtgttggagaatgttgcctatggggtatgaagatgaaggggagctggtgactgagactgggtaggagcagtcagagaggtaggagacagaacaggagggggtggagtgaangaaaggaagaaaagtaagggcttaagaaggacttggccattctttacacaaacaaggcanacaaattcagagcanagacctgggatagtgatgagtgggtttcttagtgaccatagtgagaatggttcattggcttggtgangacagatgcttatttatggggctcangaanaatgggaanaaagacatggattttataaatgtgtgctattccctttaacncattggccataaaangaaggaaaactttgaaagaacagggtanagaaatgatctgtctccaaagaagcaattgttttggtcatncangaagtaaaagccaaagcttgaaatgcaggaaatggtggggacaatgggaaancttgcnnggataaaatcctgagcntgctgagggattgtctcagaaaaataaaaacc

SEQ ID NO: 22939 - DNA, 291 bp, Homo sapiens
  misc_feature 10, 219, 224, 234, 235, 239, 240, 242, 247, 257, 260, 269,271, 272, 273, 277, 286, 287, 288: n = A,T,C or G
ggggatatancaccttgttcttcagtgtagaaagtgatttctgcatattttaaaggactggcatctttatggtaagaaagccatataaataaagatatacttagatgaaaatcggaacatgtttttaaaatagtgtgtgtctactttcatctctgttatcaaacttgctgcataagccagagttgatgctctgtgattatgctaatgaccaaaaaaaanaaaanaaaaaaaaanncctnngnggccnttttttttgngancccacacanannnaaanctttggagnnnttt

SEQ ID NO: 22940 - DNA, 691 bp, Homo sapiens
  misc_feature 5, 27, 557, 560, 595, 617, 618, 627, 638, 641, 663: n = A,T,C or G
ggggnacaggttacatgctcatttagnataatttggataatgaagaaaaatgaagtttaaaaatcaactcaaatcccaccatctggtaaaaaaaactaacaaacatgaattgagcttcatttcagagatgacagtgtctcactttttttacctctctctttctgtttctttggtttcatcgaatttggagcctctcttgagctttgatgtcttttaagatgcccactctgtttgctcttatagatcattcgttctttctatttgagtccctaaagtattattgggatttctgaagcttaaccaaaatatgtctcagtattatgcatttcctgaaacatggagtgttctttcagtctgcgtatcagtttgttctagctcagggaatttttttttaaaaaagattaagtttggctgggagcagtggctcactcctgtaatcccggcactttgggaggctgaggcgggtggatcacctgaggtcaggagttcaagaccagcctggccaacacggtgaaaccccgtctctactgaaaatacaaaaattagccgggcctggnggngggcgcctgtaatccccactgctcaagaagctgangcgggagaattgcttgaacccnngaggggggnggtgcaatganccnaaatcacaccattgcacttcancctgggcaacaagaatgaactccctctt

SEQ ID NO: 22941 - DNA, 759 bp, Homo sapiens
  misc_feature 11, 13, 16, 17, 20, 21, 33, 44, 46, 652, 748, 758: n = A,T,C or G
atatcttgggntncgnnaanncttgtcttgttncttttggccgnanggggactatttttcttttggatgattgattttccttttgctataagtttttagaagcttttttctatgtattttaacatttctgtctgtgatattttgtgtgtgaaaaaaaacacactcaatgtgttttttcctatttttctcacttgaaaacaccaatcaacacagacagaagacttctgtgaccaaatatgggggatctctctgcaagaaaaggcagcccgttctgcagtagacaccagctgggtggcctccaattcagttttgacaccatctatttggagatagcatcagatcctacaggttgagggctcaggccccaaaactggccacccccaacccgccacctcagacacagatgaaagtccagacctccaaacttctgacaggctggctttaagttggggttcccacaacttcctctttgggttcgatcagtttgcaggggcagctcacagaactcagggaaacacagttattggttattacaaaggatattacaaaagatataaggaaaaggtcaaggagcttgcctgccttcttcaggaccaccacattccaggaacctctaagtgttcagctctctgaaggctctctgaaccctctncctttgggctttttatggagatttcattgcataggcatgattgattagccacaggctatggctatcaacttaaattttaactccctcccctcccanaggtctgaant

SEQ ID NO: 22942 - DNA, 625 bp, Homo sapiens
  misc_feature 35, 436, 464, 468, 541, 567, 587, 588, 594, 596, 597, 599,605, 606, 608, 611, 615, 618, 620, 623: n = A,T,C or G
aggggtctatttgtaggaaataaagtcagtgcagnacgcatattctagtttagagttagattaatattgtgcttagtgaatttctatgacatatttctgagaacactttaatatatttccacacctactggaatctaattcagtcgatcggataaaagaaagacttttttgttgttgtttttgaaaatccataatgtagcaggttctgcgctggttttttaatgtattttatttttgtgctctcctgccaaaagaaaaggctgataagtaagtacacagtacaacatgtaaatttgtataaaaatatgcttgtttagattgctctacaataactatattaaggtaaattgtgtgtgtgtgtgagagagagagagagagagagagaaacagagggagaattgactcaatgtgttttctatgaagagtcttagcttangaatcaggtaacagagaggtcctagacnatanacccagccatcaactagcttgctgatgttgaacagatcaactctcaccatagactgaagatggaatgaagatntcaaagttccttttagcactgactanattttttttttttttttttnnaaaaananntntctttnncnccngggngantnaangg

SEQ ID NO: 22943 - DNA, 168 bp, Homo sapiens
  misc_feature 1, 9, 94, 96, 97, 101, 105, 109, 116, 118, 125, 129, 143,144, 150, 153, 160, 165, 166, 167: n = A,T,C or G
nacgacagnaagtatcttgttgcaagtccaaatcaggggagactttgttaatatgtatcttttgctcaaatttagtagggtttttttttttttngnntaanggcntttnaaatttngnatttttnaaancccattaaaaaaanncccttnctnaaaaccnaattnnnc

SEQ ID NO: 22944 - DNA, 736 bp, Homo sapiens
  misc_feature 3, 9, 605, 682, 705, 713, 716, 720, 733: n = A,T,C or G
gangacagnaagggaggcgcgttaagctggttgggacccgggaaggcctccctcttaaggtctttcccacacctctgcaccttgttacctgactttcggcttcaggatccgcagcgtgcacccgcgttccgtgagtgccctataggcagtcagcatgcccctctgcgtgtccctgtgttacggggacgccggctgggagccgcagagctatctcagaactagggcgctctcctttgggcacctccaggccattttcctttcattcgagcccacagggttagagataaaccctcactccgttgcttggggacaagggcttcactccctgtcccgagcttgcggctgagcttgagggtggctgggtcatcctggccccccactggatgggaattggctgctctggtgatttctgtgacatcccagacctcaactgtggggctctggagcggactgcgcttcacttcgtggggagggtgtttccacctaggccactcttatttctcttcacatccccagatctgtcttctgagactttgcccttctccaggaagggcactcaggagaccaggaaaatggccacagggctcctgagagccaaaaaagangtgagaattaactgtaattctatcttggctgtcacagaatgggtccattaccttttcttgtcctggagctgcttgtnggattgggcaaagtcattcctanccctagtnttnctantcatagacaggangat

SEQ ID NO: 22945 - DNA, 297 bp, Homo sapiens
  misc_feature 104, 131, 147, 291, 296: n = A,T,C or G
gggggaagttccttttatgcattggaggaaaaacgtgttggcttttctcttgacgtgggagaaattgaaaagaaggggaaggggaagaaaagatggggaagaanatcaaagaaggaaagaagaaggggaanaaaagaaggggaagangatcaaaacccaccatgccccaggctcagcagggagctgctggatgagaaagagcctgaagtcttgcaggactcactggatagatgtattcgactccttcaggtatcttgactgcctgacttaggcagccctcagcagtgctgntactnt

SEQ ID NO: 22946 - DNA, 735 bp, Homo sapiens
  misc_feature 1, 9, 39, 47, 75, 241, 436, 513, 519, 616, 623, 664, 668,674, 707, 721, 728, 731: n = A,T,C or G
nacgacagnagggcacagtggtcgactagtaatttaatnacctgctngaagaaaaaatgcattgcattagagaangataaccaaacccagagtttgtataaatatcatgcacaatgttcaactgtaattcaaaaattaccagtgatggatacagaaaaatgtgacatgtaatttttttttaaagtccatggaaatagattcctcgctgattcaaaagttgtagacaaggactttaaagcanaaattataaatatattcaggattttaaaaaaatatgttttcaggcccggtgcggtagttcacgcctataatccaccagatgtggtggcgtatgcttataatcccagctactcagaaggctgaggcatgagaatagatagcttgaacccaggaggtggaggttgcagtgagccgagattgctccactgcactctancctgggcaacagagtgagaccctgtctctaaaaatatatgtatatatatagtcataatgagggaacagatgagaaantaagcngagaaatgaaaattttcaaaaataagtaaaaagtttaaggtataatacctgaaatttttttgaagagtcattgaagtggcttaacaatagattgtanatggcanaagaaagtgtcagtaaccttgaatacaggtcaatagaaatnttantgttanaacagagagaaaaggattcaaaatgtgcagagngatctgtcaacatntcaccantcntatc

SEQ ID NO: 22947 - DNA, 708 bp, Homo sapiens
  misc_feature 572, 676, 683, 691, 693: n = A,T,C or G
gggattataggtttttagtaaaattaagcttgatgccttaaaaaaattaaaccatcaacttgtcttaaatagcttcctgttttgttttgtttgcaaaaagggtatgaattcaggcagctataaagaaaagttaactttttttctttcattttgataggtttgggaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacagggaagcttcatgataagaggaaaaaagaattttcttcctccctcatatctaatgatggggtttagcttcctttttaaggtagatgagtccttggngttggagacatcagggtgaccgaaaagtcagagtacaggatgaagacatggagacactggcaaggtggacaagtgaactcatatcagaagaaatggacattaantggaggnacccaacngngtgaagataagaaac

SEQ ID NO: 22948 - DNA, 733 bp, Homo sapiens
  misc_feature 158, 270, 444, 512, 556, 587, 619, 636, 696, 712, 725: n = A,T,C or G
ggggatatttcttgaagcttttccccttcattccagctgactggagaactattacctattcactagcatttgaaaatgaaggacaaattttgctcccttctctacaccaactttgtatgccatgggtttttaaaatgtgaaccctgcccatatattgnttctctgggcaccggccttcagtcatctaactcccttgcctcaatgaggaagtgaaactccagggctgtggagaccatgcagattccctgaataatcggaagggctcaccantgatttcctgggtccccttcaagccttggctctgccaagccacagcttagctctgccatagcctcatgtgactacagacagtcacagaggtttcattctccctcacctgtgcatgcacattgtcttgtctgtcttctcttgctataaagggatacctgagactgggtgatttanaaagaaaagatgtggcctgggacagtggctcacgcctgtaatcccagcactttggaaggccgaagcangtggatcacctgaggtcagaagctagcctggccaacaccgtganaccctgtctctactaaaaatacaaaaattanctgggcatgggggcacatgcctgtattcccanctactcgggaggttgangcaggagaatcacttgaacccaggaggcggaggagcaccgagctgaaatcatgccctgcnctccagcctgggtganaagcgagactccntcgcaaaa

SEQ ID NO: 22949 - DNA, 733 bp, Homo sapiens
  misc_feature 455, 461, 463, 464, 465, 469, 471, 479, 483, 486, 487, 490,512, 524, 538, 540, 548, 570, 584, 590, 598, 618, 640, 641,647, 658, 669, 676, 690, 691, 693, 697, 706, 707, 708, 729: n = A,T,C or G
ggggtccggcccaccctttcaaacaaatttggttgtagtttgctataataatatactaaatctatgtttatttgaaaggagcctttaccttttaaagcaaaatgcactttccttaaatataaaagtaatatggtttactttaacatttaaagttcaccttatctggggaggcagaaggaattttcatagtgcttactgtgttaattattatgagagatgaaccatatgtgataggtaaagtacatgtgtaagaaagacaaaaaaattttcctctttttataatccatgaaattcgaaaacagaaaattattcaaagaataggcaaatgtcatgacagaacttagtgtgagcaagtcattgagaattaaaatctaacttttcaggtcagagagccttgaaatacttacaataaagttataaaggcctaggtatttttctttcttttttttttttgnaaaggnannnttgntntgcccccnaggntgnnggncaggggcccaaaggccaaaatntttttctataanattttggttttagncntaaggggnagaatttcaccaaagtcttganggccagggcccttncccctnctcctttnaaaaaatttttaacctggcncagggactggctcggaactggnntgccanccctttgggancccaagggggnggatccnttgtcccccaagtnnanaacnccctaggcnnnttagggggaccccctcttttnaaaa

SEQ ID NO: 22950 - DNA, 725 bp, Homo sapiens
  misc_feature 75, 85, 544, 561, 647, 660, 700, 706, 716, 722: n = A,T,C or G
ggggatgtggtaggtacttcccggttcccttgcgtctgagggtcttatgccagaggggatagagagcccaacagnaaactcaagnatagaagaaggagaatctgcgagtgtctgtctcctgtcaagcttccctaatacagccctggtagaacttcatcaacagtggaaggcatttgcaaaggtgagcccaaaccagcacccctttccacacaggctgtccatgtagaaggcccagatgcttctcagggtctctgagaggatacaaagctactgagggggccagagggcacagcacctgggatttggatgagaagctgcaggaagggaactttgcaccccaagggcatggtgtggagtcaatagtggcaagttcagtctggttttttacatcagccggttcagaggaagagtgaaatccccaagatcagcagggcaaaatgctggaagttgtcgaggatgcagagagtagcaggaagacacctctgagaactcactcacacaccctgcccctgtgtagagatgtcatcctggggatgagaaggangaagaagagaaacgcanaaaagcctaagcaggcaccacaaagagaccgagcccgtctgaaagaggctgctctaacctgtggaaacttttttagttgccaccanacattacattccnagccttgagaaaaactgatgaaaaaaagtcttgaaaaaantcttcncacaatgacnccttgnggg

SEQ ID NO: 22951 - DNA, 720 bp, Homo sapiens
  misc_feature 610: n = A,T,C or G
ggggttaaaatatgccacattaagaagaatgagcagtagggatgaagacttggatggatttcagcaaggttttgaagcacggctaaagcttgagttggagggttggagctttctaggtggaacacaccatgactagaggtaaaaatggtctaagtatgtaaaaatcattggaatatatgtatgtatgtagagataataaaactatgttattggaggctcttaatggaacaggaacagcataatctttaaaagctggaaagactctgctgtgaggctctgcattcttataaaagctttgggtagtctaggaaacagcagtgctcaggaaatggtagaaaacaatcatttttactggtactaatataacaaatttcagcttgatagagtagtttgataaggaaccattgttatcttttgtaagtagcactaacatatacattatattcatggtcgttttttctagtcgtttatgtaggatacagaaaggagagagaaagaaaaacttttttaccctgtgatccacagaatgttaagcctcttggtagcagaacctttgtcttgttattaaatacttctgtcttccatgattagcacattgtatggggagtangagtagagagctggttgcaggatttataattaacccatggaaaggaaagagaagatgtctagattagcctgaggattataactgggttagtgtaatgggtcctggtgagg

SEQ ID NO: 22952 - DNA, 341 bp, Homo sapiens
  misc_feature 1, 9, 186, 205, 221, 223, 237, 262, 271, 273, 287, 289, 293,300, 303, 309, 314, 317, 320, 328, 336: n = A,T,C or G
nacgacagnaagggatgtccccttacacttggtattgaaactgtgggaggtgtcatgaccaaactgattccaaggaacacagtggtgcctaccaagaagtctcagatcttttctacagcttctgataatcaacccaactgttacaatcaaggtctatgaaggtgaaaggacccctgacaaaagganatcatctttctggggtacnttttggattctgactngnaattccctccctgnctccttcggggggggcccccccaanattgaaagncnccctttttgagaananaatngggaaanggntttttntttcnggnggnccgccttnaaaaaacnagggg

SEQ ID NO: 22953 - DNA, 313 bp, Homo sapiens
  misc_feature 165, 168, 187, 195, 212, 225, 229, 234, 240, 250, 255, 261,264, 282, 291, 292, 296, 305: n = A,T,C or G
ggggatttatttacatacctttgccctgcattgttatatcaaatcgacagcagactttgtattgagcattttgacaaacttttagttggaagaatataaataagggataaaaaacctgggttcctgaaagatgaggcaaaatattagggggcatcaaggaaaaantangaaaatgaagggtaccatnttgccccnccaaaaatttttgcccncatttttggtttngctnggacnattttnttttttttcntcccntttggnccnaccccctttggccccctnggaaaaaannttgncccccttgnggcccctt

SEQ ID NO: 22954 - DNA, 788 bp, Homo sapiens
  misc_feature 1, 21, 22, 682, 756, 770: n = A,T,C or G
ncggcctacggctgcagaagnngacagaagggggtcaggagtacacgcctgtgtttttctacccataagtcagtgccaactcacaggttttaaagatttctgttaaatagttccttttgtcttaattttaagtatctagcaactcaaaatttgcctcctatatggaatttatttatttagttatttttattttattttgttgagacagagtcttaccttgtagcccaggctggagtgcaatagtgcgatctcggctcactgcaacctctgcctcctgggttcaagtgattctcctgccatagcctcccaagtagctgggattacaggcacccaccaccacgcccagctaatttttgtatttttagtagagacaaggtttcaccatgtttgccaggctggtcttaaactactgacctcaagtgattcacctaccttggcctcccaaagtagctggattacaggtgtgagccaccgcgcctggcctctgggattctttttttttccagttgtttctacttacagaaaaatgatttattaaaatggccagcatttctttaagaggaataaaaaccacacccgagatatttaatgaaaaattatataaataagaaattaatagaattttaaactaagaattgaagtgcatattacaattgagatgtattctcataccataaattcnctcctataaggaaacaggtcagtgttttttagtacattcacaaagtgggacaatcaccttcctatctattccanacatttttatcacnccaaaaaaaaaaaaaaac

SEQ ID NO: 22955 - DNA, 723 bp, Homo sapiens
  misc_feature 6, 20, 22, 35, 551, 619, 694, 695, 711, 713: n = A,T,C or G
agcagnatctgtgcagcagnanacgccaatacagnacgacaaaaccagcagtcttcatctggtatggatggtgatgaaagttttttttctacctgtatttcctattaaaaaatacttggtacataaacatctgtgtgtgcagcatgagtacttacttgcctacatagaaatctgtctgaggaggcaggattgtttctttttttggttttaagtccttttgcaaaatttaattttctgttacattgttataaaagtaataggtccctaggatacaatagtgaaacagaaaacagaagtataaaattggaaacgtatcattctttttccaacctcctaaagcttttattcagaaattttctgtgcatatagaaaaaggaaaagaaaaaaccccacagaagctcaactgtagatatgttgcctcactttttaacttaacagtatatttagaacatctttccctattaaaaatctagactgggcgcagtggctcacaccctgtagtcccagcactttgggaggcccgaggtgagcaggcccgagatcaggagttnaagaccatcctggccaatagggcgaaaccccatctctacgaaaaatacaaaaattaaccgggcatagnggcgcacccctgtaatcccagttactttgggaggcccaggcaggaaaatccttgaaccaggaggcaaggttgcanngagtgacctgaaatcncncactgccttc

SEQ ID NO: 22956 - DNA, 734 bp, Homo sapiens
  misc_feature 6, 609, 642, 666, 671, 673, 675, 701, 707, 709, 718, 724,725: n = A,T,C or G
gacagnaggggtttgggggcttcacacctacccaaatggcatccacctaaacactttgggttcggctaggtgcccttaaagcctgattttcaaacgttggagaagtttagaagcaagtcgggctgtaaaattgcagcaatgacctggcatggtgtggcagccatgaagacgctcctgatcttctgcttctgggaatgtgagtgactggtggccccagctgctacgttctgaatcccgcagtggaaatccagcatggcgttcccagacagcctgcgctctgcgggctgctcccagccggggacagcaggtggaagactcctcctccccagcctcctgccttccctgccatctcatctgcatctgctgtcagacttgcgtctccctctgcctccccgcctgtctgcctccccaagaagtctcttccagagctgatcgtgtcttggcttcggtttttggaagagccgagccaacacacatcgtatttgagatacagtgggtcggaggcgatacccagggattttctccagcttggacagcgagccctttgccctctctgggtggcagggtgcctccctctaaaatgagggggcgatgcttggcagtttctanaacctgttcagatcaaggcaacctgggagttanagttccgctagtcttgtctggcanacagncngnctctaatatgcttttattggaccttncccacntntgggtgaancatcannaatgaaaag

SEQ ID NO: 22957 - DNA, 714 bp, Homo sapiens
  misc_feature 29, 499, 516, 531, 549, 581, 590, 595, 613, 617, 631, 633,642, 649, 659, 676, 677, 698: n = A,T,C or G
gggatttgaagtggggcaatggccatggnatgatccttggcactagatttcatcataggtataagtaaattagacattaggtcttgctgactttagtacctttggtttgtgagtttgatagggaaaattaagacacctctgaggaaaatacagaaagtggttttatttaaaaccactcctggttgacaattgaacaaaaagattgtatttaaaatggaaactgcaatctttgtattgtttttctactaagtaaaaaggtcagacttggatatggtacatttaaagaggatgctgattagtcacaaaattttagccatctaagagttcgttcagtttctccctaaggtgtttcccttttattaatttcctttgctttctggccccagaagtgtaactggtaccaattttaggtgtggtttctaatataagtttactcatggagacaatgaaaaaaaaaaccccagaaaaaagataatagatctgctctaaaaaatccaangttttttttgaaagtgngcatggctttttganaaactttttagtttcaanattcctggagttggagggatgacctccctccntttaccctnttatntcaccttgaaaacagtanctgncccctctgaagctnanaaacgtttntgtttgngtcaatgagngggactggaaaaaaaannccttcattccttaatgattcntttgccaaaaaagttt

SEQ ID NO: 22958 - DNA, 777 bp, Homo sapiens
  misc_feature 2, 13, 23, 36, 576, 664, 695, 705, 706, 716, 735, 749, 770,775: n = A,T,C or G
tncggctgcgagnagacgacagnaggggatctcagntggggacaaaacagtaaaagagaaggaaatgtcaaatagtaaagccacagacacatttaaaattaactttttaactgtaataataaagtaataattaaatctgaggctattaagactgttatccaaggtagcgtatggttattgattgtttatactaaagatagaattttgaccaccagttatggatattctctcacataccttctttatcatgtgttctctatttttgttgactgaactgaacattttgttatctttaaaattgactgcctgtgttattgtaagaataacaagcataaacgtacacatttgacagagaaaatatgccaatcataatgggctaaatgacttttcctaattttaggaattatatagtcagtggcagaaaagtggccaattttttctggaattaatagcacacaatataacctgggatcccacaggtaagaaaataagcaggattaactaaaatgaaatatcacttgcctagttgttcttatttttattactcttatgtatttcacttctgctgggtgtganggtgtggggaataccaaagaagtaaatggattatgcccttttagagtttatactgaatgaagacagatatgcactgtagaaatgagangatgttctaagtgcataatagatcccattgntttggaaganntttctctganaattacgttcttgaaagancttgaccctgaagnacacttacatgaagttggganaggangg

SEQ ID NO: 22959 - DNA, 741 bp, Homo sapiens
  misc_feature 543, 614, 621, 633, 648, 651, 668, 711, 712, 719, 726, 734: n = A,T,C or G
aggggatcttgttaaaacagattattttatgtcatctcttcacttaagattctctgtgatgagttctttaccccactcagagtaaagtctaattagtgtaatactgtaccaggttctacagggtctggcctctcattccctctcagacttcatcttctatttgctctttctactcagttatggtcacactggcctctttgctgttcttgaccacacctgcacactcctgcacctgcacttttatacttcttgttgcctctgcttggattgctcttcccctgatgtagaactgtatgtgaacttagtctaagtaaaacaaaacaaatcctaacttaccctatttaatcatgcaatcttcctctttgagtctgtaacctgtatacctttttcatgttttattttttctccaaagccaattgtttgtctgttattatgtttctacttcctgctagggacacgttttgtcttgtttcttgttgtattactagcacttaacacaatgtctgactcatagtagattactaaatgtttggtggataaaangatgaatgaatttttcttaaatatttttgttaccagttaacataacgatctgaaagaggcatttgattggnggatcanggacttgaccangatagaggaaaaggncanaatttatttggggggcntactatttaagcaaaaaaaaaaaaaaaaacccgggcccttttnntaacccncttaaancttgagtnccccccc

SEQ ID NO: 22960 - DNA, 758 bp, Homo sapiens
  misc_feature 1, 9, 297, 327, 357, 450, 503, 535, 558, 587, 595, 603, 612,615, 661, 667, 683, 692, 725, 726, 735: n = A,T,C or G
nacgacagnaggggatattaatatttttcaaatatgtttgataaaacattttttgaaactttaaaagtatccagaaaacttaaacataaacatttaaatcatgcattttaaagatgattgcttttctcctaaagtgtgttgttaaaatattcctgattgtcataaattgggaatgggtaatctctcagtgccttcataaaactctattcaacttaaatgactgaagattatgacataaattaattttcagagatagttttgaattattttaaatacacaacttttttttttttcaanactctgtcatccaggctggagtgcagttgngtgattccagctcactgcaacctccgcctntggattcaagcaatcctcctgcctcagcctcccaactagctggtactacaggcacgtgccaccatgcctggctaatttttgtatttttagtanagatggggtttcaccatgttggccaggctggtcttgaactcttaacctcaggngacctgcccaccttggcctcccaaaatgctgngatgtcaagcatgagccactgcncccagcctaaaaaacctaacttttgtgcncggtttgngtatttgngatacacanaanccagctgatggggctgagggacatttaaatatctaaaaaaaaatgngatcanctgagttgattgaacncttaatttntaaataaagagtctccttatggctaaaagaaannaagaaaaanaatgccaacaaagcctttaaaac

SEQ ID NO: 22961 - DNA, 552 bp, Homo sapiens
  misc_feature 349, 456, 457, 459, 460, 466, 474, 496, 498, 503, 504, 509,514, 534, 537, 547, 548: n = A,T,C or G
actgaatcagaatttaaattttaagatcacccagatgatatattttcatttaaaagctgaagccctagttccaaagaccactccagtttagccttatcttgcccctatagcctggtccttccacctcctccttcccctccttctactttgtctccactggctctcccttctctaggctcacaatggacttttcctgcctctagctctttatgtacaaagtgacctctgtccagaatttcctttcctgacctaagaaacttctacatagttgttatgaccgagaccagatatcctctcatctggagtttcttttcaaactatggcatctgacaaattacaattatttggntctgtcctctgctttatagcacattttgcttctatcttcttagcgctgattggggtggtagaattacctgctaacatgtctccttccccactagactcggggatggnngnnttttgnttctttgnttggtttcctctctctgaactnanaaagnncaggncctanagcccctaaaaaaggttgtnggngggggggggnnccgt

SEQ ID NO: 22962 - DNA, 283 bp, Homo sapiens
  misc_feature 271, 273, 275, 278, 279, 281, 282: n = A,T,C or G
ggggtcttttacccagtttctcccagtggttacattttacataatgatggtcaccaggaatttgatctcagaaccatgcgtgtgtatgtaattattttttttaatcacatgtctaattctatgatatcagcattgcaatcaaaatacagggatatttcatcaccacaaagaactccttcatgctagatatatttctttacattttcctgttagcactgcttttagctggagtccccacaacttttggaaatggttaaaattttttaaattncntnttnnannc

SEQ ID NO: 22963 - DNA, 783 bp, Homo sapiens
  misc_feature 585, 605, 623, 701, 731, 763: n = A,T,C or G
gggatcttaaatattcttaaatattctattggtgattacacagcaaatgaattttgatattgccaattcttcagtaaaattaggtatttattaattaattgtttatgttctgcctcattccaaataaagattgtatgtgaatgataggaaatgatctattaaaggtacaattattaaaataatgataaaagaaaaagagccatgtaacaaatgaagtgagaagagaagcaagaaaaggggaaaaatcaggcatcacactacctgacttcaaactatactacaagcctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcagatggattaaagatttaaacgttagacctaaaaccataaaaccctagagaaaacctangcattaccattcagacttangcgtgggcaaggccttcntgtccaagcaccaaagcatggcacaaagccaaattacaatggatctaattaactcagagcttctgccagcaaagaacnccttcgagtgacaggcacctcacctggganaaatttccacctctctctgcaaggctattcanatctcatgactcacaattca

SEQ ID NO: 22964 - DNA, 734 bp, Homo sapiens
  misc_feature 38, 568, 656, 660, 685, 696: n = A,T,C or G
ggggcagaggtgagaacttccaggccagaaggcaaggnaggtagcatcctaggggagtttactgaagagtaggaaaggcttcccggagtaggagttactggaactagtgttgaatatatttaggaatgaaccaaaaaaagggtgcttgggtatggtggctcacacttgtaatcccagcatttggggaggctgagttgggaggatcacttgagccccaaagttctaaaccagcctggacaacaaagcgggactcctgtagctgtgtgtggtggctcacatctgtagtcctagctacttgggaggctgagatggaacaataattcgagcctgggtggtagaggctgcagtgagctatgatcgcaccactgcacaccagcctgggtgatggagcgaaaccctgtctcaaaaaaaagagaaggaaacaaagggtgtgggctgggcacagtggctcacacttgtaatcccagcactttgggaggctgtggtgggcagaccactcaaggtcaggagttcaagattagcctggccaacatggtgaaaccccgtctctactaaatacaaaaattanccaggtgtggtggcatgcgcctgtagtcccaactattcaggaggctgaggcaggagaatcacttgaacctgggaggtggaggttgcantganatgatattgcccccaacacttccancctgggcacanagcagactctgccttaaaaaaaaaaaaaaaaaaacccc

SEQ ID NO: 22965 - DNA, 664 bp, Homo sapiens
  misc_feature 599, 638, 640, 643, 652: n = A,T,C or G
ggggaagattttgtaaccgtgccttttaggtagtcctaaatttctaattgtagttaaaaacatgccattttcatttctaacattttaagtatatggtttagaagtggtaagtatagttctattttttttgcaataggttttagataatttttgtcttacaaaagtaaaagtgaatactcattaattctgaaacaagttagttagcttgctttagttagatagcaagagaagggtccctggaaagtccctggcccttgggtcagtgtctcatccctgcataacataaaaggaatcctggaaaaaatcaagctgcagacactaacaaggtagctagcacatggtgttgtgcttggagacctgcccatggctgcacagacagaaaaacctctggcacatttggataaaaacttgtacaaacctccagctcactgagataagggaacaagaccgacctggcatagaaatgcctttgtttgtccaggcacggtggctcatgccccgtaattccagcaatttggaggcagaagtggccggatcacctgagtcggggagttcgagaccagcatgaccacatggagaaaatacaaaattagccggcntggtgcctctgcctgtgatccagctcttgggagctgggnanganatacttganccaggggcggag

SEQ ID NO: 22966 - DNA, 752 bp, Homo sapiens
  misc_feature 1, 9, 610, 694, 725: n = A,T,C or G
nacgacagnagggtcaaatactttatactatttagaataattttagaattcttccctttaaccattccatatcatgcctattttagtgcaaatatttcttctctttgaaaatgcattctcaaaagaagacatttatgcagccaaaatcacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtatactagttcaaccatgtggaagtcagtgtggcgattcctcagggatctagaactagaaataccatttgacccagccatcctattactgggtatatacccaaaggactataaatcatgctgctataaagacacatgcacacgtatgtttattgcggcactattcacaatagcaaagacttggaaccaacccaaatatccaacaatgatagactggattaagaaaatgtggcacatatacaccatggaatactatgcagccataaaaaatggatgagttcatgtcctttgtanggacatggatgaaattggaaatcatcattctcagtaaactatcgcaaggataaaaaccaacacccgcatgttctactcataggngggaattgaacatgagaccatggaccaggangggacatccctctgggactgtggaggc

SEQ ID NO: 22967 - DNA, 726 bp, Homo sapiens
  misc_feature 57, 578, 597, 650, 657, 705, 714, 724: n = A,T,C or G
gggaggacactgcagcacctatggacacttgtgtcgcaatggagggagatgcagagnagaaacgcaggggggtcacctgtgactgtgccttctcagcctatgatggaccgttctgctccaatggtaagtgtgaccaaggagcaggttatagggaaagtacatgaaacttaaatagtatgaagaatgcttctggcatttgatattataaagagaggataagattgaattatttgaaatggaataatttctgtaccaaattcctctattgaatttagaagggatatgactgtttttgaaaacttaaggctctcagtcctctctgggtttcttatttagaagatctctgggttaccccagcatctgttcaatgctaatcctctcgaaataatttggttttcaaaactctgtccttgtactgttctaattttaacatcagtaaagcatcattcttattttttgtttttaatttttagagacaacgtattgctattcaagcctctctgttgcccaggccggacttgaactcctaggcttgagcaatcgtcttacccattgtcccttgtgacaggactttaagngattcaaaaggccttatanaaagtcttttcttataaacaagcttctaactagaggggaaagatatttaaatnttgcagncattaacaggatcactcaaacccttgcttttgatgttgactcttttanagagggcgnggggatcacnac

SEQ ID NO: 22968 - DNA, 760 bp, Homo sapiens
  misc_feature 570, 593, 649, 739, 744: n = A,T,C or G
ggcctccttcttatataatttactataaataaacacttgaatagaagaatggggagagggaactttttttgttttcacggaatttgattttaaaaatgtaaaaagaatgaaggaaatggaaaatctcttgggtaaataatacagtaattattgacgcaggcaggatgtacaggaactcttgatgcaaagtaagtctaaaattattcgacacggacagagagagagaatgagagagaacaaacctgggagatgaattgtgaaatttggcaatggcgaggccatgagttagagcaatgtaaaattttatgcctgataaaatgggattagaggtgctgggggaaggagggaggaagaagggatagaattggatctgttaatccactttggataaattcaacagcttacccttatatttgaaatatttatttagcattgagcagctcagtggtgccagtgactttgaaggaatgagagaagctctgactctccaaattgagatgggctgagagccaaatctggaaaatcctttcatgggagaaattcaacctctccactatttccttttgttangattctggatgtctcccttggtntaaaaggagagggctaaaccaattccactgaaaatgatgcaccaaatgaccttatnccaacgagacatcgcaggcactccctgggttctttcctaaagctggcttcccaggctttaaacattaaaaactggttaaaaccttctttngacantgtatagggtggggtg

SEQ ID NO: 22969 - DNA, 762 bp, Homo sapiens
  misc_feature 1, 18, 21, 571, 647, 746, 752, 756, 760: n = A,T,C or G
ncggcctaggctgcgagnagncgacagaggggtttcaactttatgcctgacttataataatagttacaaatactacattgctagtaacaccaatatctaataccatttcctctttcctaatttcttgcagttgaagaaatggagatgagtatgtctatatgcttcactctttcctcagcaagatttatttagcatatgttttgttccaggcactggctaagtgctaggggtacaaaagttgttttgtctcccttccttccagatgtgtccatgtgtccaggctaacagagtgagtagtcacacaggcaaatcattctcctacagttgtcaggctgaaggctgacttggtgtcataaataaaaaggcagaagatatttgtattcattgtcttggatgatattttcaacttgagtaggcagattgaaaagaaaaatgcggccgggtgcagtggctcacacctgtaatcccagcactttgggaggccgaggcggtggatcacctgaggtcaagagtttgagaccagcctggccaacatgatgaaactccgtctctactaaaaatacaaaaaatngctgggtgtggtggcaggtgcctgtaatcccagctacttgggaggctgaggcagaagaatccttgacttggaagcnaaggttgcagtgagctgagatcatgccattgcaatccagcctgggcacagagcaaactccttccaaaaaaaaaaaaaaaaaaaaaaagggcctttttcnaaaccnaatnaaanct

SEQ ID NO: 22970 - DNA, 691 bp, Homo sapiens
  misc_feature 527, 555, 560, 610, 618, 624, 640, 667, 676, 683, 686: n = A,T,C or G
tattttcctttattgcaagcatctgtttatttcttgagacaaatatatacagatcctaatttctggaccctgtgcatgttactttacatggtgctatgatttaaatgtttgtcccctccaaaattaatgttgaaatttatttgccacttcaatggtattaagaggtaagacatttaagaagtgattaggacataaaggccctgccttcatagctgggatcaaaacatcataaaagagcgagttgggttccttcttgctctctcaccctttgccttgtgccatgtgatgatacagaaagaaaatcatcattagaaaccagaacttgatatttccagactccagaacagtgagccaataaatttttgcacattatgatttacccagtctgtggtgtactgttacagcagctcaaacgtactgagatatatggcaaagaagactttgctgatgtcattaaatcaacactcttgcaatggagagataatcttgaattacatacatagccttgatataatcataataaccgntgcaggtagaacagaggactgagagtcncaganaggggataggaacagagactggataatacattttaagatggagaagagcncagccganaaaacngtagctactgtacccnaaagcgaggaatggatctcctttaaanctcagaaanccgcctntgntttct

SEQ ID NO: 22971 - DNA, 229 bp, Homo sapiens
  misc_feature 157, 159, 166, 171, 173, 175, 180, 185, 196, 197, 201, 202,207, 208, 218, 223, 224, 227: n = A,T,C or G
aggggcttggatttttgtttcctattagaaaccaacagttttgttctaatttcatttcatttggagctaagatgactaatttgatgattttcgatctcttttcccctgtcctgattttaaaagccccctccttttttttttttttttttttttttangncataggnagaantntnaaaanctttnatttgggaaanntttnnttttnnaaaaaaaaancaaannctngg

SEQ ID NO: 22972 - DNA, 747 bp, Homo sapiens
  misc_feature 1, 9, 567, 661, 686, 710, 715, 738: n = A,T,C or G
nacgacagnaggggagtattatgttgaagaagagtggtgaaagtgggcatccttgtcttgttccagctctcagagggaatgctttcaacttttcctcattcagtattattttggctgtgggtttgtcatatatggcttttattacattaagaaattcttactatagtactttagggagcaaaatccacatcagaaatttatataataccaaaatggatgacttccagcagtaagacaatactctatttccagatactccactttgaaacccagccactatactttgagaaagttaagaagtgacgatgttagttggtctcacccgacagcgtgcattgactactcaatatgagtgagaaaaccctcacatgaatctcacttccaaccttcatgccaccccagttcatgccaagcagagaagtcctcaccaagacctactccaattaaagattggtaagcaaaaataaatactgccattgttttgctctactaagtattgaggtgattcgttaggcaaatgataatcagaaagagggaaatctcattgactatccagatagcttttanatgatgataatgaaattgtgaaagattacaacatgtttatcatttggaacgtatcccctttatcaatcaatcatttttttcagaaattgatgangactataaaatctgttttcatgttntaatttagaagacatattaaaagngagcntttatatgtttacattttttaangtttgaagc

SEQ ID NO: 22973 - DNA, 388 bp, Homo sapiens
  misc_feature 1, 9, 114, 181, 184, 188, 192, 207, 209, 212, 227, 232, 234,257, 273, 280, 292, 296, 313, 324, 325, 327, 328, 330, 337,354, 369, 370, 375, 378, 379: n = A,T,C or G
nacgacagnaaggggtggggtcggcgtttagttcagcgcagcgactcggggacctggagctgacgcctagacacttgtattagctttaatagaagagaaatggaggagccatangaattatttaaagggattgaaattttccaagggaaggcctgagaccatgggaaaacttggcctgctnttnttancttntttttttcccaaggngngangggttgcttttgggnggacnanactttggggggcccctttttttnaaaaaatccccaggcnttttccnaaaaccaaaggntttngggcccccctttggaanccccctatttnngnncnccccctnggggggggggggggggnaaaaccccccctctnnggganaannaaaaaaaat

SEQ ID NO: 22974 - DNA, 510 bp, Homo sapiens
  misc_feature 420, 426, 473, 487, 495, 497, 508: n = A,T,C or G
tctccttcaatgccccattcccagagaactgtcattatttgacctgctggtagttccctaaaggacgtgcaaggatgtttttatttgactggacacttgaagcttgccctgtatgaacagcccccatcttcccatgcttgtcaaaaatcagaggcaactaacactgcggcttcctgagagtctcactctgtcacccaggctggagagcaattgcacaaacacttggctcactgcagcctcaacttcttgtcctcaagtgatcctcccaccttagcctcctaagtagctgggaccacagtggagacggggtttcaccatgttggccagtctgctttcctcctaacctcaagtgagccgcctgcctcgaagatgctttatttataagcgctttggacacactttaataaatgctctattgtntacagntgaactctattaacattttgaataatattggtaatgctacccttagnactactatcatctntttattgntnacaaaattttncc

SEQ ID NO: 22975 - DNA, 586 bp, Homo sapiens
  misc_feature 34, 493, 498, 503, 506, 509, 513, 524, 527, 534, 546, 548,558, 565, 572, 573, 580, 585: n = A,T,C or G
agggagcccccaacaccctccctacacccacggnacattgggaaatggcatagcggcatttttttattgttgaaatctcttgtgggtattcagtaggctggcaccaggaatgctgggtgccagatagtcccacataatgaggaattgtctgcagaaatgccatagcactcattgagaaacaccgtggtgtgaaattcatgttgtaggtttgttaagccagtattttctaagttcagtgccaaaaagcaagctgtatgctaaggattgtgtatgaatagacaggaagagacttctttgttccacaggacattttcagaaaattcttacttttgtttggagtatcagaaattgcttacagagcagggccttagctcatacctgtgatctcagcactttgggagtctgaggcgggaggatcacttgagcccatgggttcgagaccagcctgggcaaaattccgaggccctgcctctacagaaaaaaaaaaaaaaanaatanccagncgnggnaccnggcccttgtantanccccccntttttggaaggntnacctgggagnattgttngaccccnngaggttnaactng

SEQ ID NO: 22976 - DNA, 756 bp, Homo sapiens
  misc_feature 1, 8, 19, 22, 30, 641, 712, 724: n = A,T,C or G
ncggcctncggctgcgagnagnacgacagnaagggaatgacaaatatacatgaataataggactataaggtagaaaatgataagtgccatggaagaaataaagataaaatgttaggagaatttagaaggatgagaaatctcatataaagctgtgtaagatattccaggtttaataataaggtgcatttgaattaaatttggatatataatgttccagttactatttctgcattacaaattatcataaaacttagtagctaaaaacaccaatgattttattatgcttgtaaaatctgtgggtcaggaatttggtaagggcacagtgaagatgatttgactctgtccccaagacgtctggggtatcagctgggatgattttaaggctgagacaggcttaggcttgagagctggaagggggccccttcattcacaactctggcacctttgttgggatggtttaaagactagatttgctgacttgagtgcttacatgtgacttttcctcacagcatggaaatatcactatggttgaacttcttatgggctccaagcacaaagtggaagctttatcactttatttgacctagccttggaagtcgtgttatagtggtcaaagcaattgcaagacagctatactcaanggaaaggggtcatagacacctatctcttgataggatgagtgtcaaagaattttggggctgttttaaaatcnttccacgaggcntagtctgatgtcttcctaggctaaagtaatga

SEQ ID NO: 22977 - DNA, 299 bp, Homo sapiens
  misc_feature 118, 120, 188, 192, 202, 217, 224, 253, 257, 258, 263, 266,268, 270, 279, 286, 292, 297, 298: n = A,T,C or G
ggggtcttctgtggcatttataataggagagccatttccaatatttatatttctttttagttatgaaaaagtgaccatcgtatgcctagattgtacctataatacagacctggctggngncatttgggctcatgcctgtaattccagcactttggggaggccgaggcaggtggatcacctgaggtccngagntcaagaccancctggccaacatggngaccccntctctactagaaatgcacaacttagccancgtnnggagngcngncncgcttcatncagggcngctagnacccnng

SEQ ID NO: 22978 - DNA, 734 bp, Homo sapiens
  misc_feature 552, 643, 706, 707, 710, 716, 728, 730: n = A,T,C or G
ggggttctttggaaaacagtcactaagtccagtcatgggaggtggtgggtgggaaagattacattcaaccccctggaagtgggaatatccatatgtagtatttggaatttttctatatggaaaatttgtttctccctcccaccctaatttgtttacatcagtatggactcatgtatattttgtattttgggtaacacagtatttattttgttgcttaagttgtccagcttggctattaggagttctgccaggttggctactatgtccctttgatgtgcccatccttttgatttttgagcacttcttactttctggcactacaagatgctccaggttcatcttggatattccctgccccaaccctagaatccctagaatcgacccctgctccaaagagcccctggttcctttcgttggagaatcatacttagaaaccaagatctgggcattagatgtgcttgttgctactgggatgtcactgtttgtagcagagttgagaaatatgtatgtatattaatccatgtatatgtacacatctataatatttatggngtgtacagagctaacatgagtttgactgccgtcttcactcaaaattcgtccaaaattttgtgcatatgttaaattttaagttgatattttncctattgacagaataaactcattaaagagcaaaaaaaaaaaaaaaaacccctggggcgttttnncgnatccanctaaatcttgtntncccc

SEQ ID NO: 22979 - DNA, 743 bp, Homo sapiens
  misc_feature 34, 613, 672, 683, 710, 735: n = A,T,C or G
aggggcatttgctcgcgtgcaggggaagtctggnagaaggcattgtttcaattattaaaagtgtgggggcagtgggcggaacaaacgcgccgactacagaggctggacgtaagcttagcggtggcgcgcgtgcgcagcgccggcccgagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatccagggaagatcggtctgaaattgagaggttaactgcaaaatagangaattccgtcagaaatcgctggactgggaaaaccacgcttgatttatcagcaacaggtntcttactggangcacaaggaagctctgctgacatcaanataattagctcacttgtcatcgaanaaaataac

SEQ ID NO: 22980 - DNA, 616 bp, Homo sapiens
  misc_feature 284, 286, 289, 294, 296, 298, 300, 302, 303, 309, 310, 313,319, 320, 324, 326, 328, 330, 341, 342, 343, 345, 348, 358,363, 371, 386, 391, 394, 401, 405, 414, 417, 423, 426, 427,433, 436, 437, 441, 450, 452, 453, 464, 487, 489, 490: n = A,T,C or G
  misc_feature 503, 509, 521, 523, 524, 527, 555, 560, 562, 574, 586, 589,594, 595, 611: n = A,T,C or G
ggggggctaaggtccgcgggaacccgtgagccaccgagagagcagagaactcggcgccgccaaacagcccagctcgcgcttcagcgtcccggcgccgtcgcgccactcctccgagttttccagaagtctgccgcctgtgaactctcctaggggaatctgtatcatttcccaagggcttggtgttggcaagttttgtccctcacatctgtttctctctttctgtttaattagctttgaaatctatatttttctctcttctacgtttcccaccttttttttttttngnttncccantngngngnncagggnntantgaagnntggncntncntgcctttgggnnntnaanggttcccttngcttnagggtggnccttgggaggaggtntaaancantgggccntaantaaagggcntgnactgtnaanntttttnggnntttnttaaaaccntnntaggctgggcncaggggcttatgcctgaattccncnntttggaaggccgnggcggntaatcccaaggncnnganttgaaaaccccctttcaggaaggggaanccccntntttctaaactanaaaataaccagngcnggggnngggccctgaatcccancttct

SEQ ID NO: 22981 - DNA, 658 bp, Homo sapiens
  misc_feature 527, 531, 540, 547, 553, 555, 566, 594, 600, 602, 609, 617,619, 635, 638, 653, 654, 655: n = A,T,C or G
ctttcttccagaaggagatttaaccatagtagaaagaatggagaactattaactgcctttcttctgtgggctgtgattttcagaggggaatgctaagaggtgagtgggggaagtcgattagagcctggttcacaatgcctgggaggacaggggctgaatcgctgagagtggtgagtgggcatgcagggagagtactcacccagagaaaggggtgtgtgcctgagggggtgcgcacgcacacatgtggacacatggaaaggggagaagtagtgcaaagaataaaggcctgcagagtttgggatttggtgaagaaatagtctaattgcatgttcttaagaacgtattgtagtcagaaaagggcaaacaatctttaaaatctgttctggacaactcaaggcatctattctaagagattctaaaaagaggtgtcctttatagattcatatgtaaatttgttcattacagaagtattaaaaatgtagaaaaacctgaaccagcatacatatacaacaggcgggggatagacnaacnatgcatggntcattcntaaaananattccatgcanctttagaatcgggtttttatgaaggcantttttntnattttancatggtanancctacttaaaccttgnttnaaatctttagacagnnnggg

SEQ ID NO: 22982 - DNA, 703 bp, Homo sapiens
  misc_feature 1, 9, 32, 634, 635: n = A,T,C or G
nacgacagnaagggtattcacaatagcagagntatgaaatcaacctaagcatccatcagtggatgaatggataaagaaaatgtggtatatatacacaatagaatattatatgaccataaaaaagaatgaaatcatgctatttgcagcaacatggatggaactggaggccattatcttaagtgaaataatctatgcacaaaaagacaaatatcacatgttctcacttatatgtgggagctaataaatttgattacatggaggtagagagtggaaagataacagagactggtaaaaatggggaggaggatgaagagaagtggcttaaaagtgcaaacatgcagttaaatagaaggattaaatacagtgtttgattgcagagtagggtgactatagttaacaaaaatttactgtactttgacttgatcactctgtcttatatacatgcaagagcatttcacaagtaccccataaatctgtacaaataaaaaagacacaaacatttgctccagtgaggataaaatatgataagacgaaaggtctttccttaataacagtgtgagctaaccagagattatcaacttgatcatcttttttccctctgatatagaccaacaatgattagttggttggttgnntatggaagcatattataatcaacagataccattgtctgatttgctggttggctagtctagtaatatac

SEQ ID NO: 22983 - DNA, 759 bp, Homo sapiens
  misc_feature 1, 9, 714, 724: n = A,T,C or G
nacgacagnaggggatggtagtgccccaggcactctggcacccagttttggaactgcagttttaaaagtcgtaaattgaatgaaaatgatagcaaaggtggaggtttttaaagagctatttataggtccctggacagcatcttttttcaattaggcagcaacctttttgccctatgccttaacctgtgtctgcaacttcctctaattgggaaatagttaagcagattcatagagctgaatgataaaattgtactacgagatgcactgggactcaacgtgaccttatcaagtgagatggagtctcgccctgtctccaaggctggagcccaatggtgtgatcttggctcactgcaacctccacctcccaggttcaaacgtttctcctgcctcagcctcccaagtaactgggattacaggtacccaccaccatgcccagctaattttttgtatttttagtagagatggggtttcaccatggtggccaggcttagtctcaaactcctggcctcatgtctgcctgccttggcctcccaaagtgctgaaattacaggtgtgagccactgtgcccggccaacatttcttaacctagtagtttagtttttatagttttattaccgcagtgaacgctacaccaaaaatttcatttgaattattaacataaaagaataatttttgattaaacttttaactgaattttcaatagcattcacaatnttttaaatgnttacctttacagataacttcatgagctttatttgt

SEQ ID NO: 22984 - DNA, 758 bp, Homo sapiens
  misc_feature 1, 9, 717, 725, 734, 741, 752: n = A,T,C or G
nacgacagnagggaattatcttattctctctgaaattctgtgtaagtgttagttacacgaagttaccttgaaaacactgcctcgcatttattcagtactcaccatgttcggtgcttgatatatatctcatccctataacaacactaaaaagtaatcttattagaaggcaggtattttatttattttattttatgttattttattttatttttttcagacagaatcttgctctgttgcccaggctgaaatgcagcggcatgatcacggctcactgcagtcttgacctcccaggctcaagagatcctcccacctcagcctcctaagtaggtgggacaacaggcacatgtcaccacacccagctaacttttgtattttcttgtagagacaggattttgcagtgttgcccaggctgatctcgaactgctgggctcaagcgatccgccagccttggcccctcaaagggctggaattgcaggcctgagccacatgcctggtctggtattttattttaaatcataatcccttgcaaaacatcctgcatggtagatatataacaaatgtttactgattaactttagtatttctattcaattttgccatccttgcccataattaataagtgatcaaaatattactaaattgtaaagaagtcaagcaagctgggtgcagtggctatgcctgtaatcccacactttgggaggctggggcgggtggatncctgagtncagagttcnaaaacancctgctacacnggaaac

SEQ ID NO: 22985 - DNA, 554 bp, Homo sapiens
  misc_feature 408, 464, 485, 510, 514, 515, 531, 533, 539, 540, 542, 544,545, 546, 548, 549: n = A,T,C or G
ttaaacagcccaaaacattctggagacaaggtggagtgtagtggagagagtgtgggctttagtgtcagacagacttagatgggatgtgaatatggcctttttcactgacatgccttctgatttgagtgtcagtttcttatattcaaaacgtggggataatgatatacatctcatgggttggccatgagagttggagataaactgtgagaaacactgtccttcagttatgcagcacaccctagcatttaataatagctactatgcttattatcctaacttgtgttttggccagtttttgcctgccctcataaaaaatgaggaagttggcacagtcccttgggtgagaccactccaaatacctggtgactgtttcatcactttagtcctctcatctaaagtttaaatagngttatttcttcttttcccaccctttagccatcttgtggttttcctctaacctcggntcaagttcttgaagcccttcnaaaattgccccccagacagaagccncagnnacagcctcccttctananaagtannancnnntnngaacc

SEQ ID NO: 22986 - DNA, 699 bp, Homo sapiens
  misc_feature 339, 373, 415, 589, 607, 659, 662, 670, 673, 693, 696: n = A,T,C or G
ggggcctggatttactgattgctctatcaataatgtgaccagtggaatcattcatcatcatagtgatcctctccatcatttttgaagagtatttttcctcagtttgtgcatgatttatttaacccttttcaaaatgtttttgttagccaggcatggtggcatgtgcctgtaatcccaggtacttgggattctgaggcaggagaatcatttgaacctgggaggtggaggctgcagtggaggctgcaccaatggaggctgcactgctgcactcccgcctgggcaacagagcgagactccatctcaaaaaaaaaataaaaataaaaaaataaagtttttganatgaggtaggtttcattgttttaggattacaaanaatgctgcagccacctttcttgtacacatatctggtcattgnggaaatgtctacaccgcagatatttctatagtgtagggaagttgatgcactattgctacattataggctttacatgatgcttctaatttgagtacattctgcaaatgtatctttcacgggagccgtaccaaataatattccaatagcaatatttataggaggaaaaatgtgcanaagtgcaattgagcttcncgcctctccatgggggccatgttataaaatgggggcattagcatcatctganagnggggttgnggncctttgacatcaaagctgancanaga

SEQ ID NO: 22987 - DNA, 533 bp, Homo sapiens
  misc_feature 303, 336, 423, 507, 509: n = A,T,C or G
tctccttcaatgccccattcccagagaactgtcattatttgacctgctggtagttccctaaaggacgtgcaaggatgtttttatttgactggacacttgaagcttgccctgtatgaacagcccccatcttcccatgcttgtcaaaaatcagaggcaactaacactgcggcttcctgagagtctcactctgtcacccaggctggagagcaattgcacaaacacttggctcactgcagcctcaacttcttgtcctcaagtgatcctcccaccttagcctcctaagtagctgggaccacagagacngggtttcaccatgttggccagtctgccttcctnctaacctcaagtgagccgcctgcctcgaagatgctttatttataagcgctttggacacactttaataaatgctctattgtatacagntgaactctatataacattttgaataatattggtaatgcttaccctaagactactatcatctctggattggttaacaaaaatttncnatttgacaataaagtcagtatttg

SEQ ID NO: 22988 - DNA, 718 bp, Homo sapiens
  misc_feature 15, 36, 642, 658, 659, 687, 697, 713: n = A,T,C or G
ggggttctttccagnatatatgattgtctacctagnaaaatgcaaaagaatctatcagcatatacaaaaataataatatataatacataatatataatatgtaatatataatatgtaattatatttctatacaacagcggttagcaaatataataaaaagacatcatttttatatcaaaaaaatctgtaaggtaccaagggtttcaatctaaccaaagagctacaagtatgcaaaaaattataagactttactgaaaaatgttaaagaactatataaatgaaggtagattgtgtttattgataagaagaccaaataatcagaaagattattctgatttcagttttattcaaatagatctatagactcaatgcaatttcaataaaaattccagtaggatttttttgggtagacctttacaatctttttacaaaatgtaggtagaagacataaatagctaagacattcctgaaggaaaaaaaaatcaggtggagtgtaggggatctcgctctaacataagtcaagaatttattttcaaagtgctagaatacctcatattcattggataattgggtattcatatgggataaaaccaaattacatttcttacctttcccttacacaaaaatatctttccagatgcnccaaagagttaaatgnnaaaaaaaaatcttaaaaacttttaaaanaagatatggnagaatatattttctangcctg

SEQ ID NO: 22989 - DNA, 726 bp, Homo sapiens
  misc_feature 2, 9, 66, 629, 681, 690, 694, 720: n = A,T,C or G
gnagacagnagggcgtgccaccgtcaaggcggcatgcagggctcagactaagcagttatgcacagnatatgggttaagtacagaaaacttccaagccagtaggtaggagactgcgccaggtctcctgagcaactcctcctcacatctcccaaccattctcaggcccaccccccaaaaaaaatacaaaacacataatgaccctgataggggcctcttgaatcttgtcttctgcatttgtggcatttgttccattttgtcgcagcccatgccattatcagctgggaaaacttctgaaccccactcttgatgctaggttcccatgaggcaagtgctattagaaatagtttacagacaaggaaaataagaccccagaaaggttagtgatttctgtaaggtcatatgctattaagtaactaagctgggaggcaaagccaggtcagacttccaaacccatgctttcttccactttcatccttctaaatatctccttaaaaggaagctatgaatttggcaagtagtggacataaagagatgctcttgggatgcaatatgacgtaagatcatttgaaacaccaaaaacatggctaatattagtaacaaatcagccatgctcattctttggatcaggnaattttagtatctgagtttggatgtctgtcatataatggaataagaccttantacccctgngacntaccacacacccaatcaagaacaggngggatg

SEQ ID NO: 22990 - DNA, 727 bp, Homo sapiens
  misc_feature 6, 546, 561, 613, 619, 627, 628, 639, 640, 648, 652, 666,684, 694, 699, 700, 716: n = A,T,C or G
gacagnaaggggctgagtcccaggccctctctatggccacggctagcctccagatgggcaatggtgccccagctgggccacagccagggtagcgaggcaggtgccgggagagccctcagtgacaggcggcagaacaaaggccacccagcacctgctgcctaggtagccctcaaccacctcagctgaacctgtgcattacccacaggcagccaggctcccgagtgggggcagggactcgcttcccaagtagcacctggctggggacacgggaagtgaggtcagcagtgcgcaggcagctgagtggctctttctcaagggaacacgagtagcagactcagaggggccaggaccattgagagggaaggcataggggatagaagttcacttcactgcatgtgttcacatgcctggcaatgtgctacgcacttttcatacaacattctcaatctcatcttcacaaacctctttgggcatctgtattaacaaaaacctattttaaagatacgaaaactttgggaggctgaggtgagcggatcatgagatcangagactgagaccatnctggctaacagggtgaaaccccgtctctactaaaaaatacaaaaaaaattanccaggngtggtggnnccttgcctgtnntcccactnctcnggaggctgaggcanaaaatcgcttgaacccangaggcaaagnttcanngagctgaaatcttccnctgcacttcaa

SEQ ID NO: 22991 - DNA, 705 bp, Homo sapiens
  misc_feature 473, 609, 615, 642, 664, 671, 672: n = A,T,C or G
ggggggagacaatgacacaagtatattagattcaatactggtgctctaatagggaaagttcaggctgctgtgggagcaaataataggaatgccaaactcacttactatcccagcacaggggaattattttcaatccccaacaaactaaaattacttattgaataacaactatgttctatgtactgtgctagactcttttcacttcttgttcaaaatatacatattttgagaaatatgtaattatttccagtttataagtgaggaagctataagtcagattgtttgatgggcctactaaagattatatagtggttaagacctggcctgagagtcaggcagcctggtgaattttggccctgccatcaattaactgagtgaacaagtttcctgatattccggagcatctagtttttccatctgtaaggatggagataatagtgagcattaagttaaaacatataaaaaccgcttantacagtacaaggcagctggcaaaggcaaaataaatggtagcaaaatattaaaagtatataagggccatagctatttgttaatttcatgaaaacacttatttatttagtacctaatatgtatcagagaacgattggntggtgncaattataccccatagaacagtcctangggtcatgagcttttcgagggnatgaaannttttgagacttgaaaacctctttttcgggtcca

SEQ ID NO: 22992 - DNA, 745 bp, Homo sapiens
  misc_feature 1, 8, 19, 22, 30, 44, 64, 71, 680: n = A,T,C or G
ncggcctncggctgcgagnagnacgacagnaggggaatctaagnataggcgtctaacaggcagnaaccagnattctccaggtgtgaagtaagcaatctattttcacttgctattaacagcaaacgtacaactttatctcttatttgacttcattatttggctttcaaattaacaacatgaaaactatacagaaattagtctgtgccctataagacagagatttagataatttgttcaaaacatgagatgatattcagatattctctcaaaggcaggactccaacaccgcaggtggaaaaccaacaaaaggaagaaaacagaaaggtgggggagataaggagtagccaggaaaaagaaaatagtgataaaggaagagccaaaaaggaggaaagggaagatgaaagaccgacttcaagaactaaagcagagaacaaaggaaattgaactctctagagacagtcatgtatcaactacagaaacagaggaacaaggggtgtttctacagcaagctgttatttatgaaagagagcctgtagctgagagacacctacatgaaatccaaaaactacaggaaagtattaacaatttggcagataatgttcaaaaatttgggcagcacagaaaagtctggtggcttcaatgagaagggtttagtctacttaagaaagagtctaccattncaaagagataaaaattcaggcagaatacttcaccagaagtttgaatgatttagttaaagaagtta

SEQ ID NO: 22993 - DNA, 721 bp, Homo sapiens
  misc_feature 32, 562, 607, 655, 658, 665, 670, 692, 696, 705: n = A,T,C or G
gggtactgcctgcccgttttttctctacaggnagttgaatagtagccagagtacaggcttggcatcagaaggccttagttcaatccttatctcttctacctaccagcagtgtggctttatgcaagctcttgttcatctgaaccttaccgctcttgtctgtaagggatagcaatatcggttttacagagtgggctgaaaggttaaaagaggcgctagttctttttggcatgcagcaagtataaagtaattgttgctgttcacctcctctccatgattaaagagtaggaagttgggaaaagaaggtgagcactgcagctaccttgttgattccaaacttcagtgtcttggtttttgtcttccttcttagcctcctaaatgaagagcctttatttccttctgtttagattagaaaagatgagagatctctctccttttgatgctgggtgcctggatggtattaattgattttagtgatttcttaatccatacagaatcagttaggatggtttgctcccatcttatggatgatgagacagtagtacagagcagtgggatgatttgnttggaaccctggagaccattaatttcaagatccaaatcctatggnctgtgctcattttggcagcacatatactaaagttgcaatgatacaganaanaatgggnggggnccctaggcaaggatgacatgcnaagngggggaaangttccttatttattat

SEQ ID NO: 22994 - DNA, 717 bp, Homo sapiens
  misc_feature 6, 570, 678, 714: n = A,T,C or G
gggagnaagtaattctgttctaatcatattcctcaagtatttgaaatctgtctatattatatattaggaatgatgacagataacaactgaaaatcttttttaattgtaactactgagaaaataagaatgaaaaaggcaaatggtaattattatgatcttcagaccacactcagtaaactggtactgagtaccagtttaataatagatggctttagtgccatctattctctcaaacgtaatacctgtatttcccactgcccacttgtttgatgcttcagaggtaaagaggagtttggagaagagaaacttccacccccatcacaagtgaattctcaagcagatcagttttaggcactaaagatctagaaatgggtttccttaaactatcattcctatgtatgccatgcacaaccaagacatgacatctcctggtttaaagagattcattaaatttaagaaattagttaactttgatcatacagcatttaagtgttagagtaagataacagaagagtgaaatgggaacacaaatatataatataaaataagatcaagtttatgataaaatgntatagatcttggagtttccagtataaaggaaggaaaaattgtttaggatagaaaataacttggaagtgaaaggagtatggggcatttgttgggacagatctttgctcncgaagacttatgaacatgtgacatgacagaataggntgg

SEQ ID NO: 22995 - DNA, 720 bp, Homo sapiens
  misc_feature 2, 12, 15, 22, 37, 578, 587, 616, 641, 660, 704, 707: n = A,T,C or G
tncggctgcganagncgacagnaagggaagccatggnaagggtctttaaagatgtgagtggcatgtttgatttaccttgtcggaagagcagaatatacctttaagcaagaggacactcagggggagatgacagtggcctgggccagcctggtagcagtggaaatagaagttgatagaatgagatatttcgaaagacgagccagcaggacttgatggtagattcaatgtggtagtgagggaaagaaatgggtaacaaatgttcccaggtttctgccttgagtaactgaatgtacttccagttgcttaaacaaggtggtgggcacagagggaagtgatggatttgagggctctttaggaggagaattaggagggtgtgagaatcttggacgttggggaagcatgatgtaattgaggttggagaggaatggctcccaagattttgatttatatacctaaatgaatgggataaaataggaaaaactggaggaatccaagatttgggagacataatagcatgaatttagcttgggattgcagagttttgggaataagagcctttgaaacatccaagtgaagangttgaatanccagttggctgaagataggggcctttgangagagagatgggcaggagatctacnaataggagttgatgcttanttgaaactggagaggagttcaaggctgccatgagtatgacagcnccnctgtactcaagct

SEQ ID NO: 22996 - DNA, 729 bp, Homo sapiens
  misc_feature 487, 566, 572, 576, 631, 647, 650, 683, 702, 713: n = A,T,C or G
ggggtatacccaattaataataataacatcaataataataaagacccaatcttggggacaaagaacaaataaagactgtgatcaccacaccatttgttaagacctctgatttctttaaagtggtccccattaaatcatttcacttgtacaacatggctcagggtaaagagaatgtagatttggcccaatggaaaccaatagagtctaaattacttgtaattcaacctagaggaaagtcttctaatcatggatctagctattggcaggaggagctaacaagaaacaaagatattaaagaaaccaacaatgtttttcaaagatttgcagtaccccgaagtgctgccagtttgaacgaaacaacttatgactgagccgtaaactaccctcgagccctcgactttgtgtgagcagactgaatacctactcatcttctaagaagtgcattttctcctgaaaaggatattggaaagaaaggcccacccagaangtgataccaagagccacggaaaatcatggactcaaagctacctccagaaacaaaactgagtattgatgaagcagctttnctactnccanggtagtggacctgctaaaattgctcatgggactccagaaatgctgaggacccagngattgctggattctgnctnctttctggttctaaagggacattattggaggtncctcatttttgttgcgatntgtagggcaanaacaagcttttaatta

SEQ ID NO: 22997 - DNA, 628 bp, Homo sapiens
  misc_feature 495, 576, 580, 581, 603, 615, 624: n = A,T,C or G
caatttttccattacagatttcttcatctttagactgagaaatacatgttgcaataaacttgctgccaagtgttttgattttcttccctctgcatattctctcttgaccacctttgactgacctgaaagtctttattcgtttggcatttcttttgctttcctatgtctttatatattttacttaaaaatattgcagagatttccttaacacagtacaggctattcaattttaagatccagtaagactcgattttaaattctggctctattgtttactcattatgttgacaaatgattcggtgtcttacagccccagtttcctaatctcagcatatttttttcctgagggaaactctcaagtatggaaaatctatatggacaaatacgtgctttataattttatctctactagcaagaaaaaggagccgatcattttccattatagggataaagtagatgttagtttatttgatgcaacaggacaatggtcaaggncccctgcatgtcctggtcccctgttatctcttcttcctagaatctctggcctcatctactcttctcagcccactctggctncaanngcctccttgctctttctagacncatcagacaccntttcagacntacg

SEQ ID NO: 22998 - DNA, 742 bp, Homo sapiens
  misc_feature 1, 9, 14, 641, 648, 690, 719, 730, 732: n = A,T,C or G
nacgacagnagggnactatatatcactctggctagaggcgagccccgtggcagctctgtcacccaatgccttgtcttatccttcttgtaccttccccaagcatggttcgtagcatgtgcgtgcatggttcatagtgtgtgagtactaaggaattaaaaaaacaaaaagtagtagagcaggttgactcttctttaaaaataaacatattgacctgcatggaaggtgaggctgaccctccccattctccattcatcactggattcccagcagggtgtgtgaattcagtggaatgggaagcattgaccaacctctgtgtttctgaagaagtgagagcttttgtaggtgagcagataatgtatttaaatagctctaattttacagtgaaaaacacccacagtgtgacaacatggaaagaatataatcaacttcaacccaatatactcaactccaatcccaattttggcagatagaacaaaaagtcaatacatgttatctgacattaaacagagcttatggaagacagaagtgggtgaggcagataggccgtacttggtcagatccagatgaacacccagacaaaaataggagtagagccgggtgcagtgcttcatgcctgtaatcccagcactttggaagccgangcgggangatggcttgagcccaggggtcaagaccagccttggtatttanggagacctttctctacaaaatatgaatcnctacctaggcntnggggggcctg

SEQ ID NO: 22999 - DNA, 734 bp, Homo sapiens
  misc_feature 2, 9, 684, 716, 728: n = A,T,C or G
gnagacagnaggggagatcagcaagcccccgctgcagagcggagattgggagcgcaggggcagcggctccgagagcgcccacaaaacccaacgagccctggacgactgcaagatgcttgtccaagagttcaacacacaagtggccctgtaccgagagctggtcatttctattggggatgtctcggtcagctgcccctcactccgggcggaaatgcacaagacaagaaccaaaggctgtgaaatggcccgtcaggcacaccaaaaattggctgccatctcaggcccggaagatggtgagatccatccagaaatctgtcggctttacatccagctgcagtgctgcttagaaatgtataccacagagatgctaaaatccatatgtctgctggggtctcttcagtttcatcgaaaaggaaaggaacctggcgggggaaccaagagtttggattgcaaaattgaggagagtgctgaaacacctgccctagaagactcctcatcatcccccgtagatagtcagcaacattcctggcaggtttccacagacattgagaacactgaaagagacatgagagaatggaaaaccttttaagcaaactcagggaaactatgcctttaccattgaaaaatcaagatgacagcagccttctgaatctaactccctaccccctggtgagaagacggaanaaaaaggtctttgggctgggttgtctcgtttnagctaggggctncttctg

SEQ ID NO: 23000 - DNA, 559 bp, Homo sapiens
  misc_feature 477, 555: n = A,T,C or G
ggggtctccagggttggagagatctgacacgtggagatattatgtaggtttccccaagatctcacaactttctaagagaccctgaccggtggaggaataaaatattttattaatttaaaaattttttataccatgaacattcaaaatgttggtagatttttttttaattagaaaaaagtagatttgcaaatcatctctcaaagttctctgccacttatgagttcagagctaacttggggaacaaacctggatatattcatgttctatttctgcttttatttcttattagaggcagatttttttaaaagccattcaatgtagtttagagagatttatccttgatagtatgatttcacaattgcatccatttaattgttctttgcaaagaagtacacctaaccaattattttttctaaaatgaaaccttttaaaattggagttgggccaggcacggtggctcccgcctgtaatcccacncctttgggaggccgaggcggtggatcatgaggtcaggagattgaggccctcctggctacacaggtgaagccccgtctntact

SEQ ID NO: 23001 - DNA, 735 bp, Homo sapiens
  misc_feature 1, 9, 673, 690, 726: n = A,T,C or G
nacgacagnaggggattgttcatacccttgtaataacaacacaaaatctggagaaaattcaaattcacaatttttctttaaccatcagagagttaaagtcacacggcaaccaactaacctgtacataagtaaagatagatactgacaaggtgagaccagttgtagcagacacagccagaacatagaattttgcaaaaacaacaacaacaacaaaaaggttaatgaatcaatgagtcaagtgtgagataggaaggaaatataaatatggtgagaatttgcacctgcttacaggctctttatagacctcactgaatgctcacataaaaataatagcaagattcctgagaagctgtcccttgtgctaaaggcttgaagaagggaacaacagctactgcaagaaaggcacaaaactctattctgttgcttccttcctttatccattcaaaacaaaagcctaaaatgcaggggaaagagcaacaacacagtcactcttaggaccctggtgaaaatccattgcagctaggggaagggagcagaaaaagatcattttattcttgggacagatacaaaaatacatgatgggcctagaaccacaggtgggaggagaagctgtagtactgagaaggccacatcagtgacagccagggaacgtagtgcctgctttagaccttanagttgatcagagaaganagaatgcctccttcttggtttatagactaatacgantgagtctta

SEQ ID NO: 23002 - DNA, 282 bp, Homo sapiens
  misc_feature 216, 219, 220, 227, 233, 237, 245, 246, 255, 256, 258, 259,260, 263, 266, 268, 270, 281: n = A,T,C or G
ggggccaaaacctgcccctactcctcctagacctaacctgactagaaaagctattacctaaaacaatttcacagcaccaaatctccacctccatcgctaaccccactaaaacactcaccaagacctcaacccctgacccccatgcctcaggatactcctcaatagccatcgctgtagtatatccaaagacaaccatcattccccgtaaaaaaaaanaannaaaaaanaaaaancccntgggggcnnttttttttnnannnccnccntnantaaaatccttng

SEQ ID NO: 23003 - DNA, 750 bp, Homo sapiens
  misc_feature 30, 517, 521, 549, 579, 582, 612, 693, 730: n = A,T,C or G
gacgacagaggggaagcgatgaaatccaangtgaatcttttggttggtgattttgatgatagccacaaagcaagcagggtaatgctgatgcttcaagtcttggaaccacacttcgagaatcactgttataatgtacagcagaactgcatgatcagctgtatggtagccttgaaaaccaacaggccacaatcacagtgaaaacctcaggttggcagccactggaggatacaaaatgagtttggatctccttcaatgccccattcccagagaactgtcattatttgacctgctggtagttccctaaaggacgtgcaaggatgtttttatttgactggacacttgaagcttgccctgtatgaacagcccccatcttcccatgcttgtcaaaaatcagaggcaactaacactgcggcttcctgagagtctcactctgtcacccaggctggagagcaattgcacaaacacttggctcactgcagcctcaacttcttgtcctcaagtgatcctcccaccttancctnctaagtagctgggaccacagtggagacngggtttcaccatgttggccagcctgctttnctnctaacctcaagtgagccgcctgcctcgaanatgctttatttataagcgctttggacacactttaataaatgctctattgtatacagttgaactctatataacattttgaanatattggtaatgcttaccctaagactactatcatttntggattgttaacaaaaattt

SEQ ID NO: 23004 - DNA, 703 bp, Homo sapiens
  misc_feature 485, 506, 515, 534, 569, 606, 608, 629, 664, 668, 681, 693,699: n = A,T,C or G
gggagactgggtatacagttttctccacatcaattttcagcatagggactctttcattattgccaaaagaataaaacctctaacattaccagcagacggacacactctgacagtaccaaacaatgcctctattttgcataaatatttcctgaaagctgtttgtcatctaagtcactccttgttctgggtaattgctataatcctttgctaagtatttcctgagtcttgtatctgacatcatgtttctacctatgaccaataaaggtgtatgccactcttttcagtaggagcttaattatagtgattactaagttttgctgtttagcaaaacttaacacaaggaacactcattctgctttcccccttttcccaaagccattcaccatgttgcagaaaagcaggcagcttaccttccacagtggatcctggatccacataccaccttgtgcaatctagactcctctgcacctaaaaagaatatccangccctgttgtctctgtgcagntgacattgngtacatactaatgactagnttttgattccccgagaacagtaagtaggaatttgnctatatatgtatacttaaactggtcaccaaaattggncntgcccaagagaatgccccagnataaatataatttttaccctaaaaaaaaatttgantgcntctctaaattaanatcagcttttgngagganaacc

SEQ ID NO: 23005 - DNA, 727 bp, Homo sapiens
  misc_feature 493, 538, 560, 562, 594, 607, 628, 631, 639, 647, 652, 659,679, 688, 709, 714, 715, 718, 724: n = A,T,C or G
gggaggctgtagaagccagttatcattgaaaagaggaacattttttcaaagtccaaggcttgcgctatttaagcccagccaattgttttccaaagggtgggtgacctacatctctaggagtaacagaccaaccagagagtagatgaaatggtgaagcatctattctactagaaaaacaattcaaagaaaacactgccatttccccatcttctgaccacatcatagtgcactataacctggtttccacccctaccatgcccctgaaagagtcctgcaatgctgccaatgaccacctgaccaagctgcttggtttttaggagttcctttcttgacgtttcacagaactccacaagtaaccaccccctcctaattaaaacttatttttctggttggttcccacaatactatttcttccttggttctctgggctatttagtttcactgcttcttggttcatgacctgccccttaaatgtaggtatattactcagggntcgggtgtgggggctcatgcctgtaatcccagcattttgggaggncagggcaggtggatcacttgangncaggagtttgagaccagcctggccaaaatggngaaaccctgtctntactaaaatacaaaacattanccnggcatggnggggggcncctgnaatcccnctactcaggaggctgaggcntgaaaatcncctgaacctgggaggaaaggntgcannganctgaancct

SEQ ID NO: 23006 - DNA, 748 bp, Homo sapiens
  misc_feature 20, 561, 629, 648, 657, 662, 684, 690, 709, 717: n = A,T,C or G
ggggaatgaagtcagccagnaacttccagtaccaccaaagacagtgtccagctaaaggagcatctagaccggcttatgaatcttccgctgcattccgtgaagatggaaccttgttatactaaagtcaacctgcttcacgagcgcctgcaggatctcaagagccacttcagattcccccacattgatctggtggttcagaggacacagaactacatgcaggagctaatggagaatgcagtgttcacttttgagcagttgctttccccacatctccaaggagaggcctccaaaactgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaagtgataaangaagctgctatcttgaagaaacacaacttatttgaagataacatgggcttgcccagtgaaagtgtgtncagcttaacagatctaagncccccccanggtcnaaccaggcagccctgccagganagcttntgcattctgccaggagttntgggtagngagaccctcgtaacaaaaattccaggggtag

SEQ ID NO: 23007 - DNA, 717 bp, Homo sapiens
  misc_feature 1, 9, 14, 524, 549, 653, 674, 704: n = A,T,C or G
nacgacagnagggnattacaactgtggttttataagaaatgttatctagtagaacagtagtttttaacctttttttaaattcccattttcctcctatggaaattttctcctctcaccacccctgtgaagttaaatactaagaaaaaagattttgtcagataagattgtgtagagccacaaaccatagtgatagctaagactttttttctccctctaagaaccagttttctcccacttgggagcaaaacttgccctgtcgagaatacatgcagtagaaccgactttcctaccttgctctgtttatatgagcctcatggtattctttgtgtttgttttttcctatgaaataaagaaacagcttagcaatttctacagactaaagcaaagtaaatatatatatatatgtgtgtgtgtgtgtgtgtatacatatgtatgtgtgtatatatatataaactcccaccagttgtatatagtatgtaatgtggttatatataagcaacctgatcaaattgagtttatcttangaatgaaaggtggtttttgcactanaaaataagtcagtatattttatcacattaacagattagaaaaaaaattcaaatagagcatctcagtgtatgaagacaaagataaaattcaggattcattcaggntacacactcttagtaaactanaacttaggaaaacttcataatcagataaangggctttcttccc

SEQ ID NO: 23008 - DNA, 713 bp, Homo sapiens
  misc_feature 4, 434, 437, 450, 576, 596, 629, 654, 677: n = A,T,C or G
gggnataaaataagaattataaaatgtaaagtgaatggaatgcattgaaatttgatcctgtagcaaagtcatcccttttgaattttgaacatttgtttaatgcctcttttccaagcatattttgaatattcagagataaatgagcaagttactgccatcaagaaactcctatttttctaggagagaaaggggaaagacgtgtagttgtacacatatggtttgctctaatagagtggtataaatcaaatgctattggtatacaaaaggacaaattttgtcagccaagtgtatgggtatcttcaaagagcacaggtgccatctgttctgagctaatgacccattgaagaaggccacaccaaatttgggggaaaagcagcataaacaaatgccagagtattttccaggcaggttgtatttggagaatctcctaatgntgnatatttaatttgncctttgtccaagaataatgcaatgaactaggcaactagttgaataaaaattgaaaccaagttcaaacaagcctattgaaaaatgggcaaaagactggaaaaacatggccaataagcgtaagaaganatgttcagcttgatcagtcntcaagaactaccaatcaagacccactgaggctnggggtgatggctcatgcctgtaatnccaacactttgggaggctgaagnggcaatcacttggacaggagttcaagacaacctggc

SEQ ID NO: 23009 - DNA, 724 bp, Homo sapiens
  misc_feature 27, 538: n = A,T,C or G
gggacactttcatttctttcctaaagnatgttggcaaatagaagatgaaagaataggaaataattccaagatcttcaactcttctgcattacaatatgtaaccaaatgatcttaattgtctagtcaaccaaagtttacaaaaaataaattctgccataactgtgactcaaatatatgcgaatgcataaaatatgggtaagaaagtgaatttgaggcttgaacacaggtagttaagaggatcttataagaattgccaagacttgatggctaaggactcaggtttagaatataataaggaaaggtcttctgcttctggctatgacagagttgctagaatcagatgaattcatccactgagaataactataaaacttgagaacaactataaaacttggacaaaatacaaagcaaaacaaaacaaaatctgaaagctctgtagaacaaccagtgcagccaggacctcagggaccaagatcctggagagaaggaaaacatattgaagtgagtactgctctgagtacagctatttcgccttggnatgtttgctgattcaaggcttggggcatagaggcataaaaaatgacgcattcttgagcctgtggcagttgtactgggctgaggaaccaaaatggagttcagagttaattaagcagttactacatgaggggccaagatctagagaaagtactatggacagctaaaaccatattctatgtgcattttt

SEQ ID NO: 23010 - DNA, 122 bp, Homo sapiens
  misc_feature 4, 16, 34: n = A,T,C or G
gggnatttgtaggagnaggatttaacaacttggnagttatattccaaatatttttctttcattttcaggtttacttacctccatagctgtatgtattttattcagaattttcaaatctgggc

SEQ ID NO: 23011 - DNA, 213 bp, Homo sapiens
  misc_feature 12, 151, 157, 165, 170, 171, 172, 175, 176, 180, 183, 186,193, 195, 198, 205, 208, 211: n = A,T,C or G
gggaatgccccnactaaatactaccgtatggcccaccttaattacccccatactccttacactattcctcatcacccaactaaaaatattaaacacaaactaccacctacctccctcaccaaagcccaaaaaaaaaaaaaaaaaacccttnggggcngttttttntgtannnccnnactnganaanatccttngntgntttgggncanccncc

SEQ ID NO: 23012 - DNA, 695 bp, Homo sapiens
  misc_feature 4, 274, 280, 333, 338, 344, 345, 349, 358, 359, 368, 371,378, 382, 390, 392, 400, 410, 412, 413, 419, 421, 422, 423,431, 450, 465, 503, 504, 505, 553, 568, 584, 585, 591, 592,600, 613, 623, 634, 657, 661, 662, 685, 689, 692: n = A,T,C or G
gggnatgttttgattacttagggaagattcctcatttttatttgccctttatgcatttaatccacatgataggacattaaaaattaatataaagaaaaatcgtgctcatactgtacatctgtttctgtgcttggaactacttgttaatagtttttatcgaagctgtcagcaataagggacataaaactgctgtattatacattgtggaattgaataaacagcctaatttttttttttctagtatagggtacttaagcatttccacttttggaanaaaagngtattagtattttatattgcatttcatttaaaaggacagtttttttttttttngaaancccttnnttgnaaggggttnnaaaccggtnaanggaattngggncccttttnanaaaaaaantaaagggccntnngggggncnnnatttttgnattaaaaaggggcccaagnggaaaaaaaaatttnaaaattcccccccaaaaaccaaaaaggggtttaaaatnnnttaaggggaaagggatttttaaaaattttttcccccaataaaaacccnccctggaaaaaaaancccccctccttaaggnnttttannaaacttgncctaaaaaaaggngttaaagggnggacttttttngggaattttttttgaaaaaaaantttnnttgtttttcttcccggaaaaaantggntanccg

SEQ ID NO: 23013 - DNA, 754 bp, Homo sapiens
  misc_feature 737: n = A,T,C or G
gacgacagagggattttagttaatattgtgtattaaaggataagtcttaatgctcaaagtatgttaaaaatagatgtagtaaatcagtccctttgtgaatgtccttttgttagtttttaggaaggcctgtcctctgggagtgacctttattagtccaccccttggagctagacatcctgtacttagtcacggggatggtggaagagggagaagaggaagggtgaagggaagggctctttgctagtatctccatatctagacgatggttttagatgataaccacaggtctacaagagcgtttttagtaaagtgcctgtgttcattgtggacaaagttattattttgcaacatctaagctttacgaatggggtgacaacttatgataaaaactagagctagtgaattagcctatttgtaaatacctttgttataattgataggatacatcttggacatggaattgttaagccacctctgagcagtgtatgtcaggacttgttcattaggttggcagcagaggggcggaaggaattatacaggtagagatgtatgcagatgtgtccatatatgtccatatttacattttgatagccattgatgtatgcatctcttggctggactataagaacacattaattcaatggaaaacactttgctaatattttaatgggatagatctgctaatgaattctcttaaaacatactggattctggtgctggggggttcattttaaatngagcattaagggatgcc

SEQ ID NO: 23014 - DNA, 269 bp, Homo sapiens
  misc_feature 36, 57, 67, 72, 75, 76, 80, 82, 84, 90, 92, 96, 98, 107,117, 129, 133, 145, 161, 178, 181, 182, 183, 197, 206, 212,225, 234, 243, 244, 245, 261, 266: n = A,T,C or G
gggccagagataatcaagaatccggggaaggaaaantggacaagggacccttggaanagaagaaaanggggnccnnaaanananagaatntnggantnccgagaggnttccctttcnaaaaaaaccctnaggntttaaaaggggnggcttggaaaaaaaangaaccccccttgagggnatnnnttcaaccctggggnagaaacttnaaattnccccgcgggaccnatttggggntttgggggnnncccccccccccccggnaagangag

SEQ ID NO: 23015 - DNA, 271 bp, Homo sapiens
  misc_feature 41, 134, 155, 212, 232, 234, 237: n = A,T,C or G
ggggaggcattgaggcagccagcgcaggggcttctgctganggggcaggccggagcttgaggaaaccgcagataagtttttttctctttgaaagatagagattattccactacttaaaaatatagtcattaggntactaagatattgcttagcgntaagttttacgtatttttatagcttagattttagagaaatttaagacttaaagagtncttgaggaagaaaaataaangnttntaaactgacggaggttgagatgaacttcttatgg

SEQ ID NO: 23016 - DNA, 768 bp, Homo sapiens
  misc_feature 3, 4, 8, 17, 44, 46, 47, 48, 56, 67, 759: n = A,T,C or G
tgnntacngggttcganaaacccttgcttgttgcttttggccgnannnacgacagnaggggagcaangtggaggtttttaaagagctatttataggtccctggacagcatcttttttcaattaggcagcaacctttttgccctatgccgtaacctgtgtctgcaacttcctctaattgggaaatagttaagcagattcatagagctgaatgataaaattgtactacgagatgcactgggactcaacgtgaccttatcaagtgagatggagtcttgccctgtctccaaggctggagcccaatggtgtgatcttggctcactgcaacctccacctcccaggttcaaacgtttctcctgcctcagcctcccaagtaactgggattacaggtacccaccaccatgcccagctaattttttgtatttttagtagagatggggtttcaccatggtggccaggcttagtctcaaactcctggcctcatgtctgcctgccttggcctcccaaagtgctgaaattacaggtgtgagccactgtgcccggccaacatttcttaacctagtagtttagtttttatagttttattaccgcagtgaacgctacaccaaaaatttcatttgaatattaacataaaagaataattttgtattaaacttttaactgaattttcatagcattcacaatctattaaatgtttcaccttttacagaataaacttcatggcttatttgtaacatttattgtcccacatataaagcctgnaagtataac

SEQ ID NO: 23017 - DNA, 744 bp, Homo sapiens
  misc_feature 10, 546, 616, 673, 679, 680, 703: n = A,T,C or G
gggaatctcntatggaattgtaattgtcagtgttggaggaggggcttgctggaaggtgactggatcactagaggtggtttctaatggtttagcctcatccacctcgtgctgtctgatgataaagttctcctgagatctgcttgtttaaaaagtgtgtagcacctcccctgactcttttcagccatgtgaatatgtgcttgcctccttttcatcttctgccatgattgtaagtttcctgaggcctccctataagcataagtctgtacagcccacagaactgtgagccaattcaatcccttttctttttcaattacccactctcatgtatatctttatagcagtgtgagaacagattaatacactcctcctcagaaagcattcaatttagctgtgtctaaagtatgccaggtgttctagggtgttatcttagccaataattcttcctcttcagcaagatctatttgcctatgacagcttgacctacatttcctaccttactcgtcagtaacaagtagcccataacatctgaatggacttcattgaaanacagaggtctttagttctctactttattagcaggcattcgggaaacacatcaactttctaattaataagngcctggtgctttgaaaactgctcaaagagataggagagctacttaagattactatangcatgnntgctggtcacacctgtatcctanccttggagctgagagaagatacttgagtcaaaggcatacac

SEQ ID NO: 23018 - DNA, 273 bp, Homo sapiens
  misc_feature 115, 120, 145, 157, 185, 203, 207, 208, 209, 228, 229, 230,231, 237, 238, 245, 248, 252, 271, 272: n = A,T,C or G
gggataacatcggggccttgctcaggggctgttgcatggttgccctgcattcgctccgccgcaccgccttccgtatcaaaacctaaatagaagttgttgttacccgtgtgcccantgtgnccccttgtggggttgggccaggtanaaaacaggaaancaatcttttgggacgggctttttttggnggtttggcccccttgggntttnnntttggcccctttttttaannnnaacccnntccctgnttnaaanccgggggtttttttaaggnnt

SEQ ID NO: 23019 - DNA, 336 bp, Homo sapiens
  misc_feature 137, 138, 140, 185, 186, 187, 200, 201, 202, 205, 226, 237,263, 267, 268, 280, 292, 293, 295, 298, 320, 321: n = A,T,C or G
gggggaaggggttataggatggtgtgaaaaccctcagtgagaaagttgaaagatctagttagagaaagttttggaacagtgggggaaactttaaagttgggggccaagggggaatggttggaccttttccttggttnnancccccccccccccccccccccaaaaaaaaagggttttttgggggnnncctttttttgggnnnccntggtttggaaccttaaacccncccccttggcnggggtttcctttttggcccttttttngggnncaaaaaacaaangggggggggccnncnccnccctttttggggggggcccctnngaaaaattttttttt

SEQ ID NO: 23020 - DNA, 715 bp, Homo sapiens
  misc_feature 29, 213, 269, 295, 309, 333, 458, 506, 514, 525, 529, 595,614, 619, 642, 646, 685, 695: n = A,T,C or G
gggtaattttttttttgtatttttagtanagacggggtctcactatgttggtcttgaactcctgaccttctgattcgcctgcctcagcctcctgaagtgctgggattacaggcgtgaaccaccatgcccagccttctgtttttgtttttttttcttgatgtataattgaaataaactgcacacatttatttttaaacctggtaattaagccanaaacttcccaaaacataacgattttcaacctagtaaaactatgattttttttgttngtttttgttgctttgtttttttaaanacagggtctcgctnttgtttcccaggctggagtgcggnggcacaatcatagctcactgtggcctctgtcacctgggctcaggggatcctcctgcctcagcctcgcaagtagctgggactacacgtgcatgctcttgcacccgctaattttttaatttttgtanaaatgaggtcttgctttgttgcccagcttgtcttgaactcctggcctnaaacagtnttcctgcctancctnccaacatggaaccttgatctttaaaaagcaaatcctaaaatatggctgctacctggtaaggaaaanaaaatccctctcataggcnttcanaattttcaacttttgttaaagcncatnatattaaacttgcctcttgctctaggcccttccaagagnaaaattgggnttttaaatgggaagggttaa

SEQ ID NO: 23021 - DNA, 767 bp, Homo sapiens
  misc_feature 637, 643, 647, 678, 685, 717, 726, 748, 762: n = A,T,C or G
gggagaatagggaaagaatagtacacaattgatttaaagtatcatgaaagtatttggcagttgagtgagagatacatatggttgaaagtatagggaaagctgctgggcccggtggctcacacctgtaatcccagcactttgggtggctgaggcgggtggatcacctgaggtcgggagttcaagaccagcctgaccaacatggagaaagcccatctctactgaaaatacaaaattagccagggtggtggcacatgcctgtaatcccagctactcgggaggctgaggcaggagaatcgcttgaacccaggaggcggaggttgcggtgagccaagatcgtggcattgcacaacaggctgggcaaaaagagtaaaactccgtctcaaaaaaaagaaagtatagggaaagtttattggaagaaaatattagccttgagggctggctggcattgccttggcagaagttggagataggtcattctaggtgaaggacaagcataagcaagtcaaagaggtgggaagccatagtactttttcaggtatcagttagggaaatggagtgaggtaaggattaaaaagtaggtgatccctgttgtggaaagaagatatcagtttttaatagtagctggagcactgaagcntttggntcantgaaatgaagaaatgagggcttagaaaatantgaaaanttttggattgtctttaaatatgcctggcaggncagggctcngctgatccaactttggagctgngcggaatatttagncagat

SEQ ID NO: 23022 - DNA, 785 bp, Homo sapiens
  misc_feature 543, 570, 639, 681, 700, 704, 712, 733, 734, 752, 775: n = A,T,C or G
ggaagtcctcaacccagtgagtcttggcttggtcatgtgatatactttggccaatgggatgtgaagagacaacctattcaccatcccctcgcacaacagctttcaatgacgttacatgcttctcattacactaccactctttgatgacaataacttctcatcaaaacatgacaagttatatagtagcggatatagcaaacatatatttgaaaaaaggtcatgaaaaagtaaataaaaaataagtagacacaaaagatatcgatataaggcaagccaatgagtaccagaaattaattgaaaatgatataatcatttataattatttttgtcaatgaagtatctgtttatacttcatctgcacctacatctatatcgccacatcttttcattctcatttagatgctacctctttataaatatatttttcaacaattctgtacataccatattcataacagaaatatttctatccaacacgctttgcctgcttcaatgacataaagattagtgaacacttatggcaaaagtaaatctagtgcaaangttattatccaacctttcacatgtacnatttaagggtcaacaattcttttgtcagatataaagaagcacctgtaaaaaacagacaaagcagagtanaaaaagtgttgctggctggcatggggctcaacctgtatccanacttgggagctgagaggcnatcnctgagtanaattgggacagctgccattanngaacccctcttctaaaancaaataccggccgggggctgcgnatccactctt

SEQ ID NO: 23023 - DNA, 755 bp, Homo sapiens
  misc_feature 595, 677, 724, 728, 731, 733, 739, 746, 750: n = A,T,C or G
aggggtctcactctgttgccctggctggagtgcagtggcatgatctcagctcactgcaacctctgcctcctgggttaaagcgatttctggctaatttttgtatttttagtagagatggggtttcaccatgttggccaggctgctctcaaactcctgacctcaagtgatccacccgccttggcctcccagaagtgctacgattacaggtgtgagccaccgtgcctggccaaattgcttcattttttatttctccatacttcctacataagatgctttatttctctttctttctttctttttttgagacagagtcccactctgtcacccaggctggagtgcagtggtgcgatcttggctcactgcaaccttccacctcccgggttcaagcgattctcgtgtctcggcctccccagtagctgggactacaggtgcgccatgacgcctggctaatttttttgtattttcagtggagacggggtttcaccatgttggccagtctgctttcctcctaacctcaagtgagccgcctgcctcgaagatgctttatttataagcgctttggacacactttaataaatgctctattgtatacagntgaactctatataacattttgaatatattggtaatgctaccctaagactactatcatctctggattggtaacaaaaatttcncatttacataaagtcagattaaaaaaaaaaaaaaaaaaaaaaggccntttnccnanccccanaaaactngatnccccc

SEQ ID NO: 23024 - DNA, 724 bp, Homo sapiens
  misc_feature 532, 607, 614, 639, 681, 686, 714, 716, 717, 718: n = A,T,C or G
agggcacaagtaatcctcacacgtataggactggtcactatctcataggcatagtacgtttttcagatgttactaggaggcagagacattgtgaacagaatttcactttcaggccctgggggttgagggcttattataaatggaattaagcaaaagtaccagcagtttacaattcaactgaaagtagaagtcctaggtgtatttagaagagtgagctaccctttgtttaaaccagatatttcaaggtgcagagacttagtttttgtcttttatcaaaaaatgggcagatttgtcaactgtccagaatttcatagtaagcataaagtatttttcctgctttcatgtatgtgtataccctacttttttccttaatatactatttatttattgttttaagagaatttactaaaatgagagagaggccacacctctttttcccatgaaaaacaaaataatagtttccggcttggtgcagtggctcacacctgtaatcccagcactttgggaggccgaggtgggaggatcagttgangtcaggagttcgagattagcctggccacgtgatgaaccccgtctctactaaaatacaagtaaaactagctggtgnggggcgngcacctgcatcccactaccggatgntgaggcagaaatctcttgacctggaggggaggtgcgggaganagacnaccctgcctcagcctggcacaagggggngnnnaaaaaa

SEQ ID NO: 23025 - DNA, 763 bp, Homo sapiens
  misc_feature 571, 579, 648, 666, 680, 699, 706, 725, 756, 760, 762: n = A,T,C or G
agggcccctagcattccaggaggcgaagctatgcactgcgcagaggctgggaaggctttaattaaattcaaccactgtgagaaatacatctacagcttcagtgtgccccagtgctgccctctctgccagcaggacctgggctcgaggaagctggaggacgcacctgttagcatcgctaatccatttactaatggacatcaagaaaaatgttcattcctcctcagaccaactcaggggacatttcttagagagtatgatggaaggtctgatcttcatgttggaataactaacacaaatgtgcacatggtgtccagcgagacggagaagggtgggaagagagcataagcatcccattactgcagcccaacatgtatggaatgatggagcaatgggacaagtacctggaagacttctccacctcgggggcctggctgcctcacaggtatgaagacaaccaccataactgctactcttacgcactcacgttcattaactgcgttctgatggcagaaggtagacagcaactggacaagggtgaatttacggagaagtacgtggtcccgcggacaangctgcatncaagttcatcacactctaccgggcgatacgggagcatggcttctacgtcactgactgtcccagcagcangcacacccctgaggcggnggtttgtgctgaancttgtagccacctgacctngaggtangggggtgctccttaatcanactatgattctaagctttactgggtataaancggntng

SEQ ID NO: 23026 - DNA, 723 bp, Homo sapiens
  misc_feature 1, 9, 22, 498, 546, 586, 606, 655, 670, 673, 675, 683, 685,690, 697, 698, 700, 702, 706, 707, 710, 717, 722: n = A,T,C or G
nacgacagnagggtaatctagnaaacatagaataactcttggtacatctgttacatagttaaggaaagaaacaggcaggtgaggctggagaacgttgtctatttgtaggaaataaagtcagtgcagacgcatattctagtttagagttagattaatattgtgcttagtgaatttctatgacatatttctgagaacactttaatatatttccacacctactggaatctaattcagtcgatcggataagagaaagacttttttgttgttgtttttgaaaatccataatgtagcaggttctgcgctggttttttaatgtattttatttttgtgctctcctgccaaaagaaaaggctgataagtaagtacacagtacaacatgtaaatttgtataaaaatatgcttgtttagattgctctacaataactatattaaggtaaattgtgtgtgtgtgtgagagagagagagagagagagagaaacagagggagaattgactcantgtgttttctatgaagagtcttagcttaagaatcaggtacagagaggncctagaccatagacccagccatcaactagcttgctgatgntgaacagatccctctcaccntagactgaagatggaatgaagatttcaaagttccttttacactgactanatttttttttttttnaananatctcctntnccccnggctggnntnangggnnggncgggctnctganc

SEQ ID NO: 23027 - DNA, 771 bp, Homo sapiens
  misc_feature 1, 9, 597, 606, 608, 654, 658, 680, 710, 722, 728, 732, 760,761, 770: n = A,T,C or G
nacgacagnagggatagcaaatgcttacctaaaaatagcaacaacctgcgaaaaacatcatgtgttttgccgtttttatttgaatgactatttactttgcagtctactagcaagctatagaattgtgtgatacgcagaattttaactgaagtgctttaagtgaacatttaaacatgataaaccatattaatggtgtttatgttaatatacttgaagtgaacattttctcttcatcatgagtaatataacgtacccctcaatgaaagtctagaattagagtaaatttgctaattaattaataacttttccataatatttttagttatgtgcttaaggctcttttagtgtttctcctactttttaatagcttatgccttttttgcctttgttttttattggttcattttaaagcaaaaacctcataacgtgttatttggaagcactgtaacctagtggtgagatcataggctctggggacacagcctggccacatctcttctccttctgagccttagtatcctcttttgtgttcatgagaactgagatttatcccaaagatttgataagatagtaaagtgcttcacataataccaggcntttaatacncngtaataaataaataaatattaaaaatgatggagatactattgttanatgngaaaaacggtgtcactggtggncggattgaattatacccctctggaaaaagntgaacttctcanaatttnattnttactttgatctcatccttcggatacgnnaaactaaana

SEQ ID NO: 23028 - DNA, 669 bp, Homo sapiens
  misc_feature 405, 500, 519, 550, 614, 633, 639, 651, 668: n = A,T,C or G
ggggggcgatcctcccacctcggcctcctgagtggctgggactacaggtgtgtgtgtgtgaccactcctggcttgtttttacatttttgtggagacaggtcttgctatattgcctaggctggtcttgaattcctgagctcgggtgatcctcctgccttggcctcccaaaattctgggattacaggtgtaagccactgcacccagctgagcttatgattttaaaaactaagctgtctcatatatgcatattgtttttagtgacccgtagccttcatccatgtctagtgttgttatagttattacttacaaatgggattgttgaaattaagctcatagtaaaatatatttaatttgattttttttttgactggggctagctcttttttatttcagtgctagtttaanaactccattgtcatgacatttaggattactccaggaaaggttgataatctcctccctgcacccttaccaccactgtcaccatgcaaccctacctnttgtaaaaacaagcaaacntacaaacaaaacccccaaaaccatttatggngaaatataaaacacaacacatgatgcctttaactttttgtattaaaaaataactgaactttganaaggattattttgacttancatagntacattataatntgtgaaatttgccttanc

SEQ ID NO: 23029 - DNA, 758 bp, Homo sapiens
  misc_feature 580, 638, 679, 686, 696, 750: n = A,T,C or G
gggaaggttttttttgaatgtgtgcatggctttttgagaaaacattttagtttcaagattcctggagttgaggtatgacctccctccatttacctcttatctccaccttgaagacagtagctgtcacctctgaaagctgcagtagcgttttctgtttgtgtcaatgagtgggaactgaagagtagatacctctcattcctttaatgattccatttgcccaaaaaatgtttcggggtggggagtgcatatacagctcctgacttagggaagcacatatctttccactcagaatttcaaggggaaaatgttgatagtttttagcaaaggtgtgtccaaatctgaaagttggggtttgctttcattatttctttcttttctgtatttcttcacctatcttgatcaagaaaataaacagcttatatttttctaaatttcacacgatgtaataaaatttagaagtaaaagactaggaattctgacatggtctgtacgatggtctatacagggcattaaacaatgcccagggtcaacaaatgccatatttgcaatccaacttctctctgcagtagctgccggtatncaacctgcaactgaagttaaagcttcaatgtactcaggaagacaatgaatacatgacncttctatatgcatagtcaatataacaccccacacactaccnccctcanaaaggaggtntgaagtaaaaaaaaaaaaaaccctgggcgttttcctaatcactgtaacttgagncccccccc

SEQ ID NO: 23030 - DNA, 776 bp, Homo sapiens
  misc_feature 532, 536, 622, 678, 689, 724, 737, 747, 758, 772: n = A,T,C or G
gggggatccacttcctctacctcctgttcatgcaactttgcttgttttgcttctactaaaatggttctaggtgctgtgtggacaggtgatacaaaagcctgactcacacggttgacattcattcattccattttcatttctctttgagtgatcctgacaagcagagggtctcaggtggatattactgtgtctttgagacctctctaatccttatctatctctcattttaatacagagagtttcatacgcagaccttaagtagacatagtatccagctaaaagggtctcactctgtcacccaggctggagtgcagtggcgcagtcatggctccctgtaacctcaacctctcagactccagcaatcctcctgcgacagagacagagtctcactttgttgctcaggctggagtgcattggcacaatcttggctccctgcaacctccgcctcccaggtttgagcgattcttttgcctcagcctcctgagtatctgggatgacaggtgcctgcccgaagtctcttttgccatataanggangcagtcaatggtgaatgctggcctcgctgattactacctggagacctttctgaggatcagttttctatctagaaatgggacactgncagacactgaagaaatacagaaacagccccactcagctggttgggtgctgcagtcnctggatctganatttttctgcctgatgggacggatatctctcactncactgaatttatnatgagctttnaggggaggccnaagtattttcgctntggc

SEQ ID NO: 23031 - DNA, 763 bp, Homo sapiens
  misc_feature 576, 594, 601, 680, 683, 695, 697, 708, 737, 740, 741, 742,743, 744, 745, 747, 748, 751: n = A,T,C or G
gggacacactaaaactcccacagaaagggggaaaattagaaaaggggtgatataatttgactctatgtcaccacccaaatctcatcttgaattgtaatccccgtaatttctcacctggcaagagtgggaccaggtggagacaattggatcatgggggcagttttccccatgctcttctcgtgataatgattgagtctcatgggatctgatgattctataagtgtctggcttttctcctacttgcactcactccatcctgccaccctgcgaggaaggtgcctgcttcttctttgccttccgccgtgagtgtgagtctcctgaggcctccccagcaatgtggaactgatacgtcatggaacagagggcaacctgcctcctggaaatgtggagtgtctagggagtcacagctgagatcttccttggattaaaggctgcgggtgtcacaaacagattcaactgggtgaaataactgtgaactgggcatgtgaagagaaagctgaaagccataatctcaagatggaacttcagtatccagcaaagaaatggggaaagcgttcgttatgtgggatatgctgntaccactgaacttgaagntataaanaagttctattcttacccttatctgctcagatgctgaacaacaccataactttcaacactctatttctacggtctgagcnggnagtccatcaagngnatgtgtcaggngggggaggcctttttgggggaaatgcacnttnnnnnngnncanggaaaaaaatga

SEQ ID NO: 23032 - DNA, 609 bp, Homo sapiens
  misc_feature 469, 548, 554, 570, 605: n = A,T,C or G
aggcaccagaggaggtatgccaaatgggaaacttttcatcactttccagataaaaactagcagtctgtgaaggcaactggtctgatttttcaggaaccagacactggaacatgtcgtctgatgtacatcacaccaagaaataaaaaaagaattggaaagccaatgtccaattatttactaaaacagaatccactggagagaaatgcaaaggcaggtaaaaaggcaatctcttaacatgaaaactcacaactgtaaaatgagaacctaaactatacagcgacaaactcaggaaaaagtctccagctactgctgtctctcagactctcacagtatgtgtaaccacttcctcctctgcacggaatcaccccagaagatcaactctactagatcatttgaggacaatgaacaaagtctcagactgaattccacagaaacattctcttgaaacccccatattctgggtgaagtnaagagggcatgtgttcggagacaccaaagcacatgctcaaacacaactctggattgcgactctgccattctggtctttnatcaantcaagggccttacaanaacgttcaaactgcctcagcttttaaaaagcttgntgcc

SEQ ID NO: 23033 - DNA, 759 bp, Homo sapiens
  misc_feature 631, 670, 685, 687: n = A,T,C or G
gggcacttaaaatgtgaatgaggggggcggggtgggggtggctataatgccagcactttgggaaggctgaggcagtaggattgctggaggccaggagtttgagaccagcatggccaacatagtgagaccccatctctacataaaataagaattataaaatgtaaagtgaatggaatgcattgaaatttgatcctgtagcaaagtcatcccttttgaattttgaacatttgtttaatgcctcttttccaagcatattttgaatattcagagataaatgagcaagttactgccatcaagaaactcctatttttctaggagagaaaggggaaagacgtgtagttgtacacatatggtttgctctaatagagtggtataaatcaaatgctattggtatacaaaaggacaaattttgtcagccaagtgtatgggtatcttcaaagagcacaggtgccatctgttctgagctaatgacccattgaagaaggccacaccaaatttgggggaaaagcagcataaacaaatgccagagtattttccaggcaggttgatttggagaatctcctaatggtgatatttaatttgtccttgtccagataatgcatgaactaggcactagttgataaaattgaanccagttcaacagcctattgaaatggcaaaactggaaaantggcatagcgagaananagtcacttgtcagctcagaactcatcagaccctggcgggggggggctctgccggatccaccttggagcgagc

SEQ ID NO: 23034 - DNA, 732 bp, Homo sapiens
  misc_feature 1, 9, 15, 26, 630, 640, 644, 692, 711: n = A,T,C or G
nacgacagnaggggnatataactggnaagcatccaagccaagcttggcaccaataagacagtaacatgatagaattgaagcacctgatgcttgattgaactacatgaacttcacggtctttccaaccgtactctgtttttttccctctgcctgctgtagataccttttgtctttgcacagttaagcctttctttcctttttattgcctttcctcactcaaatctttgacttcatttgctgtagtcaggactaacagaacttctatataaatatggacctaatattctaaaatcatgcggctaccagcaaaagcttgagattgtgttttggggagtacctttatactggtaacacgttctagcctctggggacacctcaacattttctctaccctctccccgcattcagcacccaggatgagatgcgcttagctcaggcagtcaggctcagaaaacacataatgaagctctcagagtgggaagtatgaatgacctggatggaagtcacctttagtgcctccatcacctccacagtggtaggattgatgtgtgtgcggcccgagggcaaagcttctcaactcttgcgccagatgtgccctaatcatggagctgagtaatgcacactccccanagccctgttngcangcatgacaagcactgatcctggattcttcaactgatagttggttttgnaatcattccatttgtaccnccccccccccccctgcccccc

SEQ ID NO: 23035 - DNA, 710 bp, Homo sapiens
  misc_feature 79, 607, 634, 683, 685, 689: n = A,T,C or G
gggaacacactctaaacttaacactaagtttctagaagatcagattgtacatcatcctgagaccatgccttcagaagantattatgcttatcattttgtaccattccctaaattccggttcattttacttgatgcatatgacttgagtgtcttgggcgtggatcagtcttctccaaaatacgagcagtgtatgaagatattgagggagcacaatccaaatacggaactgaatagtcctcaaggactttctgagccccagtttgtccagtttaatggaggattcagccaagaacagctaaactggttgaatgaagtgctaacattctctgacacaaaccaagaaaaggtggtgattgtgagccatcttcccatttacccggacgcctctgacaatgtgtgcctggcctggaactacagagatgccctggcagtcatttggtctcatgagtgtgtggtgtatttctttgctggtcacacccatgatggtggctactctgaggatccttttgggtgtataccacgtcaacctagaaggagttattgaaacagctccagacagccaagcctttggcacagttcatgtctatcctggcaaatgatgttgaanggaaaggcagagttcagatagaattgngaatacaagaaagaaagagccttcattggtagtctaattattttactgnanaatnaccttggggttggcctctaac

SEQ ID NO: 23036 - DNA, 756 bp, Homo sapiens
  misc_feature 578, 618, 647, 652, 669, 673, 677, 682, 693, 697, 698, 703,710, 721, 725, 736, 744, 745, 749: n = A,T,C or G
agggggtactcttgtggcaaaactgctggcaagtgtaccctttctgcagaaagtaaaaatggccttgctgaggaaattaaatttatgttcaagtgctatcctttacagcaccagggaacaagcatttctaacaatagcttatatttactacttaatgtttgatttacttttattgcaaataaggtcaaatcaaacatttacaaactggtacaataatacttttttgtaattagatatacaccaattcatactgacaatataacaaataattgtaatattcagttctagtattctactcaccacaaatccaacatttatttttccttctctattcttcctgctgaaaatgttaatctcttcagacaattatttgctatgaattcaaataactgctccaatctaataattgttcatataattcatcttaaatgatacaggtgaaataattttctcttatggctgacataagacagtctttaattacaaaaacaattaccataaaaaattgtggccattatttccataactatctttctttctcctcccttccacttctgggacttcagttgcagggttgntagactgcctgatgttgcctcaccagtcttgaggctctgntattttgctttcagcacttttctctctgngcttnttctggagttctgtgcntgantaanttaangggcttctttnttannctggncttctantactttatccntcangaaattcattnagctggcnngganctcacct

SEQ ID NO: 23037 - DNA, 351 bp, Homo sapiens
  misc_feature 270, 283, 288, 296, 302, 309, 312, 321, 341, 345, 349: n = A,T,C or G
cttctcttgctcatataataaattactaaatggactaaatcattatgtaattaccaaaaaattgttaggcagaacaattgaaaacaggttcttcgtgataagcaatgaaagaacacatcgtacagccacagacttcatctgaagtcatctctctgatgatttatttttgcaagaagtaaagaattacttgtgtctttcaaagcatattctcattcttttagttggtgaatctctgggtcatacattaggaaacctaaagaccttttgctnaattttatttaanatacntgactgtnttttcnttttctnttntctgctttnatgaattcttctgatgtttnctcnaggnac

SEQ ID NO: 23038 - DNA, 769 bp, Homo sapiens
  misc_feature 583, 596, 649, 650, 684, 695, 704, 713, 728, 751, 754, 760: n = A,T,C or G
attctctgtttagttacatagctgtattgaagtctctgtaaatgaaaaatttacccctatccctcaacatgtaggttgagaacagaaatattaatgggtgtgatttattaattcctgagggctattagcccatcaatagactacttcaaataaccattagtctcaatagtattgattaattccccaaatgcatttaaagcaatagtatatgaagtgcccctaagtgagcctcacgtttcctcattctacagataagaaaccaaggtacagagacaacaagtgacttatcccaagtcacacaggagttagaggcagggccaggacccaaacccaagtttcccttttatgagtcagctcatttcctgtgactccatattaaagatgccactctgaatttgccttggaagctggcgcttcagtttataacacaaattgacactttaggaagacaagagagctttgtattctccctgcaatcatttactcagtcaggaaaatactaaacactgtctttgcgtagaatataatgctactgatgtgaggaaaagaaatccagtgcctggcacatagaaaggatagatcnccttttgtgggangaaaacagtggaaaacatgactggagtctcagctctaccattactaattatgnnctttggcaatatttgaccctctgaacttggttcnctctggaatgngaaaataanctactatanaatatgggcaataantagggaaagctggtccagagggnaanaaatgnctcttagga

SEQ ID NO: 23039 - DNA, 763 bp, Homo sapiens
  misc_feature 616, 658, 661, 677, 710, 758, 759: n = A,T,C or G
gggggagatgatattcaggtattctctcaaaggcaggactccaacaccgcaggtggaaaaccaacaaaaggaagaaaacagaaaggtgggggagataaggagtagccaggaaaaagaaaatagtgataaaggaagagccaaaaaggaggaaagggaagatgaaagaccgacttcaagaactaaagcagagaacaaaggaaattgaactctctagagacagtcatgtatcaactacagaaacagaggaacaaggggtgtttctacagcaagctgttatttatgaaagagagcctgtagctgagagacacctacatgaaatccaaaaactactggaagtattaacaatttggcagataatgttcaaaaatttgggcagcaacagaaaagtctggtggcttcaatgagaaggtttagtctacttaagagagagtctaccattacaaaggagataaaaattcaggcagaatacatcaacagaagtttgaatgatttagttaaagaagttaaaaagtcagaggttgaaaatggtccatcttcagtggtcacaaggatacttaaatctcagcatgctgcaatgttccgccattttcagcaaatcatgtttatatccatgacncatagcagcaagcaggagagtgcaagacatttattttacgtngcnttgaattgtggaaaanaatgtctgaaaaaatgtaatgattgcttctcangaaaggggagttttatgaagctacttccgatcattcctagccactttnnaatg

SEQ ID NO: 23040 - DNA, 772 bp, Homo sapiens
  misc_feature 563, 613, 622, 662, 696, 706, 712, 735, 736, 746, 748, 752,754: n = A,T,C or G
gggttacaggcatgagccaccacgcctagcccctgttgtgaacttctaaaaaactatttggaagtgcaaaaccagcaaatcttaggaccaagaaaaggtaaagcagccatgttttaaagtaattaaaaatataataaattgataatataatacataatgatcaatttcagaagctctgcagttctcctctcagatgctacaacctggagccttgagagctctcatttctaaagataacgcatacataagacccagaaatggtacatcaggaaacctctattgttatcagtggcactattattatagaggctaagttgtccacagaaggtaaatgatgggaaggaaagactaaatgactgaggggtagaattacaaaaggacattatggcccaagtattgtacattatgcttacaaatatctgggaatatacatttcttctcagtatttctctgtattattgcatttctttcagcattatataaatgcctgcactgccaactctgctcatgttataaaaacaaataaacagcttctcataaatgtaaaaatgaaagaagctaangaatacattatatgttattttgagtgtcagtatgaatcatgatttttttncttctatangctcatcaagaatggctgattttaatatggggcagatttntagatagcctggacacttgtttaaagtaaaaagnggcggcccgngctacnctgtatccacctttggagctggnngcaaaacagncngaancnaactctgtaccgggaacc

SEQ ID NO: 23041 - DNA, 193 bp, Homo sapiens
aggggtcttggaagctcctgtctgtgaagggtgtgcacagagagcttcggtagcctgcgaagcagccattttcacttccacggagcagatgctggcctgggtgctggaatatggaaatgaggaagatcctgcctgaggatttcatgacagtgctgcgattaccgacgtgagccactgtgcccagcctcacttt

SEQ ID NO: 23042 - DNA, 661 bp, Homo sapiens
  misc_feature 1, 9, 27, 569, 629, 632, 637, 643, 644, 645, 646, 647, 648,649, 651, 656, 657, 658, 659, 660: n = A,T,C or G
nacgacagnaggggtaaccacctgggnaaaacttcacagaaaatgagagtttcagatactgagaatagaaccactaagaagcagaaaagagaagatattctcgtgggggagaacaacggctgggaggggaggaagcatggccaaggcaaagaggtgggcattaataagaactgcttcttgctgccgccatatgaagaaggacgtgttcgcttccccttcctccatgattgtaagtttcctgagacctcgccagccatgctgaactgtgagtcaattaaacctctttcctttataaattacccagtctcgagtatgtctttattagcagtgtgagaatggactaatacacctgccatgcctgttccttacttactaaaaaaatttactccccttttctccatagaatgcacgcaatttgaccttatgctacacttccagtctctactcctgcctctttatgctctgtccacatgtgatgtctcactattctctacatggcttgtgcccctataaggtttgtgcccttcatttcctgtgccctctacctctggttcccatgctcagatagncagtgtccttactgcaggggtgtataagctcagatctcacctcctcatgaagccctatanacncccanaaggannnnnnngnccctnnnnnt

SEQ ID NO: 23043 - DNA, 748 bp, Homo sapiens
  misc_feature 2, 5, 8, 10, 13, 15, 17, 18, 29, 40, 42, 60, 554, 662, 683,700, 713, 714, 717, 722, 725, 726, 727, 730, 731, 733, 734,735, 736, 738, 742: n = A,T,C or G
tnttnccntncgntnanncttgcttgttncttttggccgnancggcctacagctgcgagnagacgacagagggaaattacaaacacttgaaatatactgggattgtgtttattctctgtttagttagatagctgtattgaagtctctgtaaatgaaaaatttacccctatccctcaacatgtaggttgagaacagaaatattaatgggtgtgatttattaattcctgagggctattagcccatcaatagactacttcaaataaccattagtctcaatagtattgattaattccccaaatgcatttaaagcaatagtatatgaagtgcccttaagtgagcctcacgtttcctcattctacagataagaaaccaaggtacagagacaacaagtgacttatcccaagtcacacaggagttagaggcagggccaggacccaaacccaagtttcccttttatgagtcagctcatttcctgtgactccatattaaagataccactctgaatttgccttggaagctggcgcttcagtttataacacaaattgacactttangaagacaagagagctttgtattctccctgcaatcatttactcagtcaggaaaatactaaacactgtctttgcgtagaatataatgctactgatgtgaggaaagaaatncagtgcctggcacatagaaangatagatacccttttgngggaggaaaatannggnaaacntgnnnggnngnnnntntccnttacta

SEQ ID NO: 23044 - DNA, 773 bp, Homo sapiens
  misc_feature 1, 9, 35, 460, 510, 590, 594, 664, 691, 713, 716, 718, 729,738, 741, 742, 752, 761, 765, 771: n = A,T,C or G
nacgacagnagggggctcataggggagcttctagnaaggaaggacttattgtcttagttacttgatccacttccttacctcctgttcatgcaactttgcttgttttgcttctactaaaatggttctaggtgctgtgtggacaggtgatacaaaagcctgactcacacggttgacattctttcattccattttcatttctctttgagtgatcctgacaagcagagggtctcaggtggatattactgtgtctttgagacctctctaatccttatctatctctcattttaatacagagagtttcatacgcagaccttaagtagacatagtatccagctaaaagggtctcactctgtcacccaggctggagtgcagtggcgcagtcatggctccctgtaacctcaacctctcagactccagcaatcctcctgcgacagagacagagtctcactttgttgctcangctggagtgcattggcacaatcttggctccctgcaacctccgcctcccangtttgagcgattcttttgcctcagcctcctgagtatctgggatgacaggtgcctgcccgaagtctcttttgccatataanggangcagtcaatggtgaatgctggcctcgctgatactcacctggagaccttctgaggatcagtttctatctanaaatggacactgcagacactgagaaanacagaaacagcccaccatcacntgntnggtgctgctgncacttgatntanntttttctgcntgaagggangganatctcnca

SEQ ID NO: 23045 - DNA, 684 bp, Homo sapiens
  misc_feature 19, 592, 630, 634, 635, 639, 648, 649, 650, 651, 653, 655,656, 658, 659, 660, 669, 681: n = A,T,C or G
aggggttgctatgacaggnaaccgcatgagacacacacgaaagacggccctgccttccagggctcgctagatccttggttcctgtcgtggaagagaggggcagagtcttgctctgtcacccaggatggagtgcagcggcgtgatctcagctcattgcaacctccacctcctgggtgcaagcgattctcctgcctcagcttcccaagtagctgggattacaggcgtgcaccactacatccagagactgggactacaggcatggattttcaggtttataacatggcagagtgaattctggcaacacactgagtgatgcttgtcagtggccactatcaggaatttaaaacaagagggagggcctagctctgtcgctcgggctggaatgcagtggtgtgatcatatagctcactacagcctcgaattcctggactcaagcaatcctcttgcctcagcctcccatgtacctgggactacaggtttggaattatgacatctggacaaacacatatgcaaaacctaccttttggtccattctccagggcttcttctgcagcttctggttccagttcgttttcggagctgtcagtggggngttttggcctgtcattaactgacatcatattacttggnacanntgcnttccttttnnnnangnngnnngaaaaccanccctactacttnctg

SEQ ID NO: 23046 - DNA, 530 bp, Homo sapiens
  misc_feature 444, 445, 448, 451, 452, 454, 457, 459, 460, 468, 476, 479,481, 483, 485, 487, 515, 525: n = A,T,C or G
gggtgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctactcgggaggccgaggcaggagaattgcttgaacccgggaggcagaggttgcagtgaggtgagatagcgccattgcactccagcctgggcaacaagagcaaaactctgtctcaaaaaaaaaaaaaaannganggnncnccnanngggcttangggaaaanatntntntnanatttggggggtttttaaaaacacaaaanttataaaatntggga

SEQ ID NO: 23047 - DNA, 767 bp, Homo sapiens
  misc_feature 2, 3, 12, 21, 22, 28, 34, 47, 56, 61, 69, 75: n = A,T,C or G
annacttggggnaaaaaaccnncttttnttgttncttttggccgcangtagacagnagggnaacactgntggagnatatatattaatatcacctttccccaatactggttatcacgaaggatgacttcctagctcctgcaagttaaactgtttttaacacctcattggattaattgacttaactaacactgcaggctttttcccctttgataacatttattgaacatacactgtacagtgaatattgtagttaggagttaggatctgtgatggaggaatcatcatgcggtagaaagaaaatagatttagtatcaaaaaataccattctgcagccttggcaaaaatcactttctctgagccttagtttcctgatttgtaagagcagccgttgtactctaggatctcttcatggttttctcagtacaggttgagcatccgtaatccaaaaatctaaaatccaaacatgctctggaagctgaaactttctgaatgtcagcatgatgccacaagtggaaaatctcacacctgaccgcatgagacgggtcacagtgagaatgcaggctcacagcatacagtctgttcagcatccgcaggcgaaaaataaaatcaccttccggctgtgcatacaaggtgtatatgagactttggttccatccccaagatttctcattaagtatatgcagatattccagaatccaaacacttctggtcccaagcattcagatgagtgatactcaacctctacccacctagctttctgagattct

SEQ ID NO: 23048 - DNA, 803 bp, Homo sapiens
  misc_feature 8, 11, 14, 16, 27, 38, 40, 47, 56, 58, 60, 61, 69, 77, 98,685, 739, 769, 794: n = A,T,C or G
ttgacctncgntcnancttgcttgttncttttggccgnancggcctncggctgcgnanannacgacagnagggcagnactgggttgaatccacaaggnatttgtattccttatctgtatagcagcctatttccttatctgtgcattagggacattcaaaggattaaatgagatacttcagaaaagcaaggattgtgagaattaattaatcaaagatcaatgccaatctcagtttctggtatctagtaagtgctcaataaatgttagtttttagtactgtttctattattcttattgtctagagaagagatggaaagttagtcctgtttttcggtagtgtgtctcacttttcctggatctgaaagatactttcttaaatgatataacttttttccttatcagtaaaacaaaaatctttgctgttaaaaactgctgcagaggcttggcatggtggctcatgcctgtaattccagcactttaggaggctgagacaggagatttgcttaagcttaggacttcgagagcagcccaggcaacatgtgagactccatctctaaaataagatgaataacataaaaaattaaaactgctgcagaaatattatttagaaggcagaggggtgagttatcataaattaacctattttgtgtgggaaatgaaaacttgtactagtaaaaattgctttnccatgtatcctcatccaccaattggctgccgcttaatgtgatgggactatttangcagcactgcccccattggtactgggaagnccttgcaagttccagtcctttacangctttttgg

SEQ ID NO: 23049 - DNA, 765 bp, Homo sapiens
  misc_feature 1, 2, 9, 142, 558, 587, 694, 724, 740, 755, 761: n = A,T,C or G
nncgacagnaggggtattagtatactgtgagaggtaatcattaatggcatatgttaaccgtcagtgaatggaggcggaaatagtttgagaactactaccagatgaaggaggaaatagaagtgccaggaaaacagaccaaggnaacagtggttaaaggcagaagagttccaaagtagtatattgccttgaacagagtctataaaagtagaaaaaggtcattcatatgtaatactgcagagaagttaattggatatggttatgaagaaattattagagaaattgcatatgtcaaggcagaagggtctcagtttgtgtttaggaggagggctgcaagtaatatgaaaaagaagaggattttgggattgaggtcccctgggagtgttgagaagttgaattctagagctgtggttcctgacctacaagccctgaagttgttacagggtgttcattgcttattcatatgcttataactttgtctgtaagttgaataaagattgttctagatcattgaataataaaaatttaacccattgttgtgaaggagcctcagaatatttngatgttaccaaaagagttctgtatttacnaagttggagaacactcttcaagagttaggagtaaggccagtgtgggggtccctctggtataccagcatttggagctgagggggcaatccttgagtcaggagtttganaccacctggccacatagcgaagcccatctntctaaatacaaaatanccactgttggggacnccctgnatcc

SEQ ID NO: 23050 - DNA, 758 bp, Homo sapiens
  misc_feature 2, 9, 14, 635, 657, 686, 703, 723, 725, 727, 741: n = A,T,C or G
gnagacagnagggnattcaattgtcccttcctcttgtctctaccctctttaataaatgaataaagatgcattaaaattaatgtaaagtgcttcggattagaagtcaagtgacgtggattctaatccttgttctgtgtactaacagtgatttggcataagttttgtaatctctccaagtatctgtaatctcacctagatggaagaaattattatccccacaagtatccactcaccacctcacattgagataagtatttgcaagggttttagtcgcttacaaaggcagcatacaagtgttgagccttattatggccaaaatcacacacacacaccagacatgcgcaaacatacacgtatcatatatgcacatacatacacatattatacacgcacttacgtgatgtttatgagtttccctcttggtgtcctagggttaccagacataaaatcccatccttttacttttctcccttggctaatagtatacttttgataaggtcaagtaagtgtcattttatttgccaacattgtgtttctaacaactgtccagggttgtgttgaaataaattttctccacaaaatgtgtgtctaattaatgaaatgtcaactttatttatttctaggtggcagttggnttttttcaccattgcaaatganaagattaaaatttccagttaaatggcagngaacttttatttttgtnaaactaaggaagggttgagncngnttactacattattntttgatctaaaaaaggc

SEQ ID NO: 23051 - DNA, 783 bp, Homo sapiens
  misc_feature 2, 11, 12, 13, 16, 24, 30, 34, 126, 693, 696, 714, 756, 778: n = A,T,C or G
tncggctgcgnnnagnacgacagnaggggnaagnaaatatttgcaaactgttcatctaatagtggactaatacctaaatttaccaaaaacccaaacaactcaacaggaaaaaaaaattccactggnaaagtggccaaaggatataaatagacatttctcaaaagaagacatacaaaaggccaaaagatatatgaaaaaaatgctcaacatcactaatcattatataaatgcaaatcaaaaccacaatgaaatattattttcccctagtcataatgactattcctaaaaacaaaaacaaaaacaaagcaaaacaaaatataacagattgaaaaaggaacccttctacactgttggtgggaatgtaaaccagtatagcaactgtagacaacattatggcgattcctcacaaaagtaaaaatagaatcaccattggaaacagcaattttactactgggtatttgctcaaaggggaaaaaaatcaatataccaaggggatacctgcactcgcatgtttattgcagtacttttcacaatgcaaagatatgagaccaacctaagtggggttttgggcttatgaaggtgatagtaaaaagactcagggtttgtgaagttggtgagggattttgcaaagctcttcaaactgcatgcagaactgttgaccagtgaagatggccaaggtggacggctcagcancanggatgtgctggtgcgcangggcagtagcatgagtgcaggtgtcccagcatgtttggggtnctcagtcccagtgggctggaanaggga

SEQ ID NO: 23052 - DNA, 686 bp, Homo sapiens
  misc_feature 1, 27, 517, 580, 582, 649, 658, 667: n = A,T,C or G
nggagcacacctgttgcccccaacagnaggcagaaccatttctctttcaagcatgggctactgataaattcagctaggcgagctagttcagccttctcattaagggaagttaagagagaagtgatgaaatcttaaaaattaggagtaactggacatttcgttaagggagatgcattacttcttacagcactaggtatgagttgaagtcaatgcattttaaacgtggttttcctaaattgaagtctttaaaaaataaaactttaagaaagtatcctaaatacatatggtaaaaattttcacaaatactgctctttggccattcaagaaatcttcaaatgaaatatgatgttggaattttttctgcagcagttattctgatgtaatatacatctgccttattttttccatcactaattttttttcagtttgggtaataaaacttgttcatgaagcgtggtatatagaccatttttaaatggccctactccagtggacttcaagtccaaaatgcaatgangagttttcctaatggcaaatgtgcatcttttacatttttgtagcatggagggggaggcagtanangactgtggatgattttagctctgctctcaggcagagagcatcatggaaatgtgtccaactgctttangagctcctntgacttgcncgtacctcctttattcctg

SEQ ID NO: 23053 - DNA, 746 bp, Homo sapiens
  misc_feature 578, 608, 621, 625, 631, 652, 672, 682, 683, 687, 692, 694,696, 707, 714, 717, 724, 734, 739: n = A,T,C or G
ggggagtcattccacaaacttgtcttgagcacctgttatgtacccagcactgtgctggaatgctgaggagacaggagtgaagtaaaaagacatggttccggcaggaaacaggcaaggagagccttgacttgacggagtctggctatatcgccaggctggaatgcaatggcgcgatctctcctcactgcaacctccgcctcccgggttcgggcgattctcctgcctcagcacctcgagtggctgggactacaggcgcgcgccaccacgcccagatgagaaaactgaggcgcagagaggtgaaataaggaatgaaatattactggatgaaataattatactgatcctagccttattttaaaagggcccccagaatgctcttctccaagacttagaaaaatcaaatgctatccatccctcaagatacatccctccagcccctccttgaagtctcctgcagctagaagtagaagtagcatctatccccatctggactccttagcactttgctgtacctgccttagtccccatctctttacacacacacacacacacacacacacacacacacacacacacanagagtttataacactatcacctattatatnacattatattatnggantcacangaactacaaggaattctctgngaattccttaggggggggancatttacaanntcantgttntntnttgggggggancaaaaanggngcccganaaaattttcnacccncctgctt

SEQ ID NO: 23054 - DNA, 248 bp, Homo sapiens
  misc_feature 183, 195, 196, 203, 210, 212, 216, 217, 220, 221, 226, 227,228, 233, 240, 241, 242, 243: n = A,T,C or G
gggctactagcagtgttagtcagagcaaatagggtacaatatgtttttcattattttaacctatggagagaatgttgtttaagtcctcaaggacaagcatgtaaaaagtagacatgatattattttggttaaagctatgttttaagagaagactcttggggagaaaaaaaaaaaaaaaaaaanaaaaaacccccnnggggccnttttttncntaannccnnccttnnnaaaancctttgnnnntttgg

SEQ ID NO: 23055 - DNA, 766 bp, Homo sapiens
  misc_feature 583, 595, 734, 735, 753, 759: n = A,T,C or G
agggcacaaaagtctgcagcttcagtcctgaagccagcgagaccacgagcccaccaggaagaacaaacaaactccagacacgccaccttaagagctgtgacactcaccacgagggtccgcggcttcattcttgaagtcagtgagaccgagaacccaccaattccggacacactgggattacaggtgtgggccactgcgcccagccaagcatgccattctttagaagatgttctctcctggcacatctcagtttctacaaaggcccccagcccttcctggagacccctggggcgaagttctctcacccttcttcacatgcccataacaactcacctccctctctcttagagcccccgtcctgcccttccttgaattctggtcatgctcatgtttgccatagctccccaaggaagacagcctctgagtcaggtctgacattgtctgtccttaaagaaggcacttaacacatatttgtcaactgaattaataaaaatttcccacagggccttggaagaaattttgtacctgtttgcctctgctggatgaagcactctgaacacagctacctaaaagtggaaggaangaggccgggcanggtggctcacgcccataatcccagcaccttgggagactgagtcagtggatcacttgagctcaggagtttgagaccagcctaggcacatggcgaaatctgtctctacaaaaaaaaaaaaaaaaaccctggggcgtttttnntaatccaaatgaaaaacnttgggngtgaccc

SEQ ID NO: 23056 - DNA, 812 bp, Homo sapiens
  misc_feature 1, 8, 18, 21, 29, 612, 695, 726, 737, 763, 770, 786, 792,795, 803, 805: n = A,T,C or G
ncggcctncggctgcganagnacgacagnagggatgtatagtaaaatgtattattaaatgtagtacagaatatcttattcagattacttttgaataaccagaagatagcctattatactgctagatggatggttgacatgttttttgcattaaaaagtatgatttttacagcatatggaaaagaaggtgtgaaaatgaacttcatagatcggatctttattggtgaattaactagcacggtcatgtgtgaagaatgtgcaaatgtaggtactttagaattcaattcagcatggaatggattacaatcacatcatttttattatattttctttcacatataatcattggcagtcatttttaaaatttgacagatgattacataatgattcttgaaagtctttttatacgctacactcctagaaagtaaatgtgataatttatatatttttaaaagtaaatgtatttttgtgttatttttcctcatgacacacctatgaggcagttttagcctatcttaatatactgaaattcattagctatctgtttgaagtgagagaaaaacttctgtgaagagagtaactgtgctacgttgcagtgccctaaatgtaattncaggctgggtgcagtggctcatgcctataatcccagtactttgggaggccaaggcggcggatcacttgaggtcaggaattaanactagcctggccacatggggaaacccatctntactaaaaaancaaacattagccagcctggggggggngccttantcccatgctcgggagntgagcnganaaactgancnccggcgg

SEQ ID NO: 23057 - DNA, 619 bp, Homo sapiens
  misc_feature 2, 3, 12, 22, 34, 47, 60, 539, 550, 565, 566, 588, 589, 591,592, 595, 599, 602, 603, 611, 614, 615, 617, 618: n = A,T,C or G
annacttggggntaaaaaccgnctttttttgttncttttggccgcangggcagcacatgnaagtacatttcagagcgtttgttttatcttgctagtttcgaatgatagattcctgtgaaagccaacaccatctcttctttgcccttgactgtgacctgcatgttaaaagatctagttttctggttatgctactgacttagaacattggaaaaccactttatacctgatttccctttaagcactatttatttgccatcttgatatttcagaatccttcaaatttatttagaggactttgaaaatatatcattgcacataaaatgcagttgattcaaaagagaacatttaaaacatacattttattaatcaaacttttattgttttaaaatgaagttttattttggccagcaccagtggctcacgcctgtaatcccagcactttgggaggccaaggcaggcagatcaccttaggtcgggagttcaagaccagcctgtccaacatggcaaaacctcgtctctactaaaaatacaaaaactancctggcacagnggcatgcccctgtanncccagatacttgggaggctganncnnganaatnctnnaacctggnagnngnng

SEQ ID NO: 23058 - DNA, 784 bp, Homo sapiens
  misc_feature 1, 8, 18, 21, 29, 38, 41, 47, 713, 747, 769: n = A,T,C or G
ncggcctncggctgcganagnacgacagnagggttagnagngtaagnatattatggatgataaagtactaaatgaaacataatatttatttataaaagtgtgtagattgttaaatcacaaaaagagtgctatgaccattatgtatgaggaaacaggcctttgacctcctggaaagcactgctcaaaagtcattagtgcccatttttgaattccccaaacagaaagcttcttagaaaacacgctgagattttatttacagggaattctttgacacatttcaattggtgtgtagtcaagtatagcaagtacttaataatgactgaatttcatgttcctacagtcatacatattcattagaagttttatgttgttggtctgatctgattcttctttgttgggtggaacggcactgagagaagtatagttttttaaacttgaacatgttcagtagttacattgccttagaaaacccagacacatagcagtggaaatgaaagaaatggcatcagaagtgacttaatttagcaattgtgattcctcttgtaaaacaaaacaaaaaaacaatgccatattttttggagaaaagttggcaatataggggtttcgttgtctgtttcacaagaagactcatttgttcttttgggggaaccagtgccttacagattttgtatatactgtaattattcaggactagggacaaacaattgtattgnatttggtacagatgatatggctttgtttacattnccctaataaatggcttcttctnccttggaaaaaaaac

SEQ ID NO: 23059 - DNA, 754 bp, Homo sapiens
  misc_feature 9, 43, 676, 733: n = A,T,C or G
gtagacagnagggatcaccaagggttgttccatttgccctggntctccctctatctcagcctggccatcacttcccaccttatcccaagctttgccactgtctctaggacttagaacttgtaaatttgatttgccttgccttctacttcctttctagtggtgactgagttgaaaagcaagttggaagccactgcttttaaagaaaagttttgcttggtttaggtttttccaattttatttttgttaggagccaggggataagatttattttaaatgaaaatcctcttcctaggttaagccattttttttattgcttaccaaatgtgcctttggttagggttagtggagctttattagtcactatttgaataactggaaatcactgccatttccaggagatcacctatcctagttttgaggaatagtcattgaggtgggtttccttaattgcatctcttctagtaggcagatctgtttgaacaagataaatcctaaagagccagcctgcttgaggagtagacttggtgggtgaagccagcaattccgcacaaacgtcatgttgaattgttttgggctgcccaaaaacaacaggatgcagcatcctggctgtggcctggccctttgtgcagcagtggcatggacagcaactgctaattcgagacttactattggcttncagcacaccctacagtgagcaggggatgagacgtggacagctcctgctttggttaanatgcagaatcttagaccagac

SEQ ID NO: 23060 - DNA, 774 bp, Homo sapiens
  misc_feature 9, 580, 672, 750, 753, 757, 763: n = A,T,C or G
gtagacagnagggggccttttctctgcctagttgtttctcatcaaatttgatttgaggccaagtgctcaccctggtgcaagggcagattgaggagtatttttcttgtttgcaaccacaagctgaacagaagtcttttcctttttggaaattcccttaactcccttttactataactctaatctctgggactctaagccacagaggtgagactgagatagatcttgccttcctctacctcctttgttaattataccatccctcaggttgaaagtgaacaactttgggctttctatcttctctacattttatattctttctgcctagggcagcaagcctcatggtgagctaaatatacaaggagtagcttccctaaggtgtatcctggctcaacatgtggtccatgggtcaacagcagtggtagcacctggaagcttattagaaatgcagaatctcaggctccacctggcctgagatgcatcagaatttgcgtttttaaacaaaatccccaggtgacctatatgtatattaaatgtttagaagcacaggtgtagaagaaactgcatgatctagcttacttangcttaggcctcagtaagttaatgagggttaaaaagacttaggaaatcttttttctcttgaaaagcttgcttttataaaccattaagttgctncaaatcctattttgaatttgaactgaaattactgttttcttctgcataatgcgatatatcattaccctctcaggaaanaangttntggcanactcaggagtt

SEQ ID NO: 23061 - DNA, 783 bp, Homo sapiens
  misc_feature 9, 11, 12, 19, 21, 731, 775: n = A,T,C or G
ggctgcganannagacagnangggttggccaggctggtcttgaactcctgacctcaagtgatctgcctgccttggcctcccaaagtgctaggattacaagtgtgagccactgcgcctggccagaagcccagtttaaaccagcattaaaaaaagaggattttatgggttctggggatcagactacctgaaggacagtggtggagctggcctcaggaaggaccaagccaggagctcacacaccatcaggtctctcatactctctctggctctctttcctctttctctcagacaggcttccttcacacagctggcagcaaggccacaagcaggtgccaggctataccttccagcgtgactctggagaaagctccatcaatctctccttcacttttgaccctctcagtccacacagcccagagcagcaaagagctctgaatgaccaggttgggccagatgcccagctctaggtcattcctgtggctatggggtaaggtcatatataccttggaacacttccctggaaaaggtgagcaggaaccaaacaattaaaataactccactctcggctgcatggtttttctgcaggactcacggatgacaatctctgattgagatcacattaaacacctactatgtgctgagtaggtgctaggccctttatatacatttaaacctctcaacaaccctgaggctaagtgagtataacaatagaggtctattccccaaattanaagagttgggtacttgctcatggtcacacagtggataatgatanatgagacc

SEQ ID NO: 23062 - DNA, 636 bp, Homo sapiens
  misc_feature 541, 569, 577, 588, 592, 593, 595, 598, 599, 600, 601, 606,610, 611, 622, 623, 624, 625: n = A,T,C or G
tgtgaaaggcgattcctccaccacctcttaggatcttgggcaagtcactcagcctcgctgagcctgtttgcatcagtagggttttgtgaggctccagcccttcaacagaacatttgctgagcatctactgtgtgcccagcagggccttcttagatcaggtataaggcaggagggaagcgtcgggagtcccaggcctgctgcctctgtaaccatgggcaggtggttcaacattacctccccttcttccccactgctctgccccatcctggcttttattgtatctcctctaaaagggtgtgagctccacggggaggtacccatgtgctttgaggaaggtctgccccagtttatattcaataagtactttttgaataattattgcaaagactagttctcagcacagagcttaacacataggaggtgtttgataaatggcaattgttcatgcaataaagaacaatagcaggccaggtgcgcggtggctcacacctgtaatcttagcactttgggagtctgaggcaggattattgcttgagcccangagtttgagacccctgggcaatggtagngggacctnatctcttaaanaaanngnaannnnaaaangaannaaaagaagacnnnntttttacccgg

SEQ ID NO: 23063 - DNA, 769 bp, Homo sapiens
  misc_feature 9, 689, 702, 723, 755: n = A,T,C or G
gtagacagnagggatatagagagagatagtggttcacagtaatcatacaaagtctttattccatccactattataaacatttctattaaaactaaaactgggctctatgtaaaaaccccaaagatgcacacacaaaaaaaatctgtttgttagaactcaagtgaattcagtaaagttgcagaatacaaaatcaacatacaaaaagcattggcatttttatacataaataatgaaaataatgacctaactgaaaaattaagatgccatttatgatagcataaaaaaaaatacttacttaggaataaatttaacaccaaggcagtaaaagatctgtatgtacactgaaaactatgaaacactgatgaaagaaagacacaaataaatggaaaggtatcccgtgctcatggatcagaataatactgttaaaatggtcacactacccaaagcaattcagaatcaatgcaatcctatcaaaattccaatggcattatttacacaaacagaaaaaaatcctaaaattcatatgtaacgataaaagaccctgaataggcaaaagaatcctgaggaaaaaatgttggagacatcacatttcctaattataattatactacaaaactatagtaatcaagacagtatggtactggtataaaaaacatcacaggccagtgggcagaagaaagagtcagatntaatccaactacncagtcactaattttgacaagnaccagaagacctcgggaaagacgtctcttagngtctataagagtgg

SEQ ID NO: 23064 - DNA, 773 bp, Homo sapiens
  misc_feature 513, 582, 586, 592, 594, 635, 645, 648, 651, 673, 685, 708,713, 717, 742, 755, 765: n = A,T,C or G
ggggagagctgcaaggccacaagtcccagggcctctggaagctgtcactgcctctgaaatccttgcagaaggctttcagccttacaaggcctgtgggtgagaccttgccccagaccatgggctccttcagcctcactctgcctggtatctctgggctgggcacagaggaacatcagggtgaacgaatgaatgaacagacaatgcacacatcactgggtgatcttggagaaggtgcctctgctccctcacatgatctgtgacacccagatttggcaaggcccagagcagtgagtgttgtataagttttgccatcctggtcctgaagcagggcccagcttggtgctgtgagaaacagcccacctttttgttacctcctgtgtctctatgaaggaggactggaagaaaccctactgacagggcctatcatcttaaaggaatattttgggctgggcgcggtggctcatgcctataatcccagcactttgggaagccgaggcaggcggatcatctgangtcagtagttcaagaccagcctggccaacatggtgacaatccgtctctacttaaaaaatacaaaattangcanggcgcngnggctcgcctgtaatcccagcactttgggaggccaggcggcngatcacgagncanganatcgaaccttctggttacaagngaaacccctctntctaaagtcaaaaatactggggnggggnaggnccttatccactctcggaactgagcngaaatgctgaccngagggagctncatagcac

SEQ ID NO: 23065 - DNA, 798 bp, Homo sapiens
  misc_feature 4, 38, 40, 47, 57, 60, 67, 75, 77, 593, 607, 616, 637, 651,653, 666, 695, 704, 721, 725, 728, 755, 764, 770, 771, 783,785: n = A,T,C or G
tttnggtgcgaaaaaccttgctttttgcttttggccgnancggcctncggctgcganagncgacagnagggaagnanaaaaacgttggtttatttgtggaagagaagggcacattaaaaaggaatgcccacagtttaaaggctcttcaggtagcctttccagtaaatatatgactcagggaaaagcctcagcgaagaggacccagcaggaatcatgagggaaggaaaatgcagcactctaaatggccactcaggcgttcctattcactcggaaaattaggttcatttcacaggacacagcagtgtagatcaggcttcaacttaacatttaagggaaatgtcagatttttttttaatttaatgaaattgttaatgaggaaaaatttttaatatagtcttatctaccacacatccccatagatttaaggattttaatagaaagtcatgatgtatgtatttaagccacgttaaaagaaaaaatataactatggaccggtattcagtgaatacagtttcatggtttttaattctttcaaagcacattaaaaatggtgtgctgataaaccccaagtaaattaaccctttttccgtatnaatccattttttgntttgaagangggaaatatatttattggtgntactgaatcctggngngaaagcctatcanatatgtatgaactgctactgctgtacttncgatttacnggcatcattttttgctntttntanacgtgataacatgaacatgagtacctnttttgtggncttcannggatgggcaggncnctcaaggctttgg

SEQ ID NO: 23066 - DNA, 571 bp, Homo sapiens
  misc_feature 19, 57, 182, 357, 484, 489, 506, 507, 511, 515, 521, 530,532, 535, 536, 551, 552, 555, 557, 558, 565: n = A,T,C or G
aggggaaggactaaaacanttgggaggatcactgccgaaatcaatgcaacctcaggnagtttaatctatattgagggtgtgctttctcttgaatttaggaccaactagcaataacaaatattgaagttaccagagacttccaatggtctgttggttgctgttctccacttgaaagggttggntggttactcccgactccagacttcctttccatttatgtatgtatgtgtatatatgtatagacggggtctcgctatgtcgcccaggctagagtgcagtgactgcggttgagctcactgcagcctcaacttccccaggctcaggtgatccttccacatcggtctgcaagtggctganactacaggcacacaccaccacgccaggcaaatttttgtattttttgtggagacaggattttgccaacttgcccgggctagtctggaccttctgggctcaagggatctgcccactttgggaggcctangtganaagatcacttgaggccnngagntcangaccanccttggcancntanngagtccccatctctnnaanannttttaanattatg

SEQ ID NO: 23067 - DNA, 745 bp, Homo sapiens
  misc_feature 2, 603, 616, 626, 629, 680, 693, 712, 724, 733: n = A,T,C or G
gncgacagagggtaaataaaaatcaaagtttcaaaatcaccatgttggaggattattgatgaactttggcaatttgtatcagcaatttgaactttgacaatttgtatattcagttttgggtgggccaagaaataaattgctgtgtgattgagatttatgctggaaacagctcagttttaatagaatatccacatgtcatcactatctttattcttctcttcattccttaaggaaaggaaccatatatttttctttattagcacctgttcagcgcctagcagtatactttttgatgaatgaatgaaagggtgtggtatgtatgaggagtacaaggaagagcattacagattgagggaaccccagggaaatcaggtacttattcttgttatgcactttaagcttttaaagggaaagaaaagtaaagaatacaatgagaaggaaatgttatagaattctagaacttttgtaccactttatagcagaatgccttgcacatagtaggtacttctcaaatatttgttgaatgaaataaatgctgaggcaaatattgatgaaaaatggtttctgcctttaagattttactggcaattcatattgtaagtntgaagttgcgaangatcaaaaantanttggttaaagatcctaaatgctaaagataggactagtaaaaaataaattanggcccggcatggnggctccccctgtatctcanactttgggaggnggggggggnggatcatctgag

SEQ ID NO: 23068 - DNA, 759 bp, Homo sapiens
  misc_feature 19, 20, 28, 31, 33, 50, 57, 181, 184, 240, 252, 320, 349,352, 384, 434, 547, 568, 581, 611, 640, 664, 673, 678, 679,681, 686, 711, 714, 732, 733, 739, 746: n = A,T,C or G
taagggtgtctgtaaacanngggtatantantngtttttttgtgggaaanaaataantattcgacaaaaaaattatttggaacagtgatgtgattcggctgtgtcccctcccaaatcgcatcttgaattgtagcttccacaattcccatgtgtcatgagagagacccggtggaagataatngantcatgggggcatgtctttcccatgctgttcttgtgatagtgaataagtctcacganatctgatggttntataaagagcagtttccctgcacaagttctcttttcttgtctgctgccatgtgagatgtgtctttcancttctgccatgattatgaggcctccccanccncatggaactgtgaatgcattaaacctcttttncttatacattaccctgtctcaagtatgcctttatcagcagcatgaaaacngactactacagacagtatctagtgcacagtaagagctcagttaatattgaattaaaaatgccagtaaaatgatgctacaccaattgtgttggcaatttaaatcagctcacagnggcttaaaaacaaaatagagntcattaacttgtntctgggaatttgaaagtgggcttgagtcancccccttcagtttgttcaggggttctagntcccttttctctctttctcttggnattactggnttgtnngntgganatttgcctttaggatgactcccctnctnattggaaacctacttccnncaaacnaaaaacnttttcccccctat

SEQ ID NO: 23069 - DNA, 720 bp, Homo sapiens
  misc_feature 28, 713, 718: n = A,T,C or G
ggggtcttgctctatcaaccaggctggnagtgcattggtgtgatcatagctcaccataacgccaaactcctgggccgaagcgacctgtgtgtgccatcatgcccagctaatttttgatattttttttagcgatggatctccctctgttgcccagactggtcttgaactcctgagctcaagcaatcctcctgccttggcctctcaagctactgggaccacaggtgtgagacactgagctcggcccatcaacatttaaaaaatatccaccacttgtggggactgtgttaggtacagggattagagggtagaaggatacaaagatggataagctacatccctgctttcaatgcacctagtctcctcagagagacagtcacacaaagagatgattatatcgtatgatgtggaaagtacaataatggcgcatgtgcagttatagaagaggactgaggagaggcgggagttaggcacagcttctgggagttcagacctctgaactgtgcctcaaagaaccagtaaaagtcagtaagacaggcagggcactgtggctcacgcctgtaatcccagcactttgggaggccgaggtgggtggattgcttaaggtcaggagtttgagaccagcctgaccaacatggtgaaaccctatctctactaaaaataaaaaaattagccaggcacgatggcaggtgcctgtaatcccagctacttgggangctgngg

SEQ ID NO: 23070 - DNA, 579 bp, Homo sapiens
  misc_feature 547, 567: n = A,T,C or G
atactatatacattgtaggggtgggctgcgagctaatacagcatttgaatgcaagtccaaatatgtaaattaaaaataaggttaaacttttctattaaaggaaaagattctcagaatcaaaaataaccaaataaagcttactctgtcatacacaagctatatctctatatcaaatgccagaatttaaaaataaaaggatgggctatgtgaatgcaaagcacatgattgttttatattcataaatggtgaaacccacaaagaacatacaataataggaaactaaggtgaaaatatagcatttaaaatattaaaatattcaatgttaatgaaaattgttatacccctctaacgaacaagagaaaatatcacttctttttttttgagacggagtctcgctctatcacccaggctggagtgcagtggcgtgatcttggctcactgcaagctccgcctcccgggttcatgccattctcctgcctcagcctccctagtaccttcaactataggcgcctgccaccacgggcggctactttttgttttttagtanagacggggttcaccgggtancaggatggtctc

SEQ ID NO: 23071 - DNA, 763 bp, Homo sapiens
  misc_feature 9, 19, 527, 558, 582, 658, 685, 713, 728, 733, 745: n = A,T,C or G
gggctgggnaggccgaggnaggcggatcgcctgtggtcaggagtttgacaccagcctggcaaacatggtgaaaccctgtctctactaaaaatacaaaaattagccgggcatggtgtcaggcacctgtaatcccagctacttgggaggctgaggcagaagaactgcttgaacccaggaggcggaagttgcagtgagccgagattgcgccattgcactccagcctgggtgacagagcgagactctgtctcaaaaaacaaaacaaaacaaaaatcagctgggaaaggtgacatgcgcctgtagtcccagctactcaggaggctgaggcacgagaatcgcctgaagctggaaggtggaggttgcagtgagctgagatcacaccactgcactccagcctagcaacagaatgagactccatttcaaaaaaataaataactaaataaattttttaaaaatccacattataaattatgtattataaaagataaagaatgaaataactgttcagattaagggacactaaagaaacnaagcagtctaatgcaatccatggtccacggntttcttttgctattaatatatagnacactgtccaaacagctaatgtcctttatagcaaagacagtcctttttactgggggaaaatctaaatgggggctgncattttgttgatgcattatattaaccntcattttgggccggccgtggggctcacncctgtattcttggcnctttnggaggccaaggngggaggattgcctaactc

SEQ ID NO: 23072 - DNA, 648 bp, Homo sapiens
  misc_feature 375, 418, 498, 549, 560, 570, 582, 588, 637, 640: n = A,T,C or G
aaggtcaaggcgtcagctaatttggatcttagtgagggctcgctttctggcttgtagacagctgccttctcactgtgtcctcacatggcatagagagagagcacgtgcacaagctctctggtgtctctttttctaaggacacaaattctatcataaagactctaccctcatgacctcatctaaacccaattacctccccaaaatttcatctacaaataccatcacattgggaattgggagtccaacatatgaattttgggggtacacaaactttagtccgtaatacattgtgctataagtttgatccagttagatagctcaaataacagattaatattctttactgggcatagaccctgtcccagagcatatcanggcatccgttattattttgtgggttaaatgggacctcatctangactttttggagtggaaatagcacttataaaataagttcattagtacatatgcacttagtaaacatgtactttgaatctncctgaatcccccccaaaagagttgaaaaatgtgaacagcaaaacttaaaancctatgattangtgacagaanatcctcccaatnccaatntgaatgggaccagcatcaccatttcaaaacctgtgggattcaacatttnganggaaagac

SEQ ID NO: 23073 - DNA, 783 bp, Homo sapiens
  misc_feature 11, 14, 42, 46, 201, 543, 554, 621, 623, 633, 641, 683, 687,698, 700, 706, 708, 710, 717, 720, 730, 738, 740, 749, 767: n = A,T,C or G
cggtctgcganaanacgacagtaagggggccacattgagggncagntggggaccttcctttccagtcacactctgtgtcctcacgggccccttcacagtctagataaggagcctagtttcattctcaaagaaaaagtatttggtcttcaacatagaaagcacaaaagcccagacgagactgagcacactgttcgaatccantgccagctcatctgtgtcagggctggcttctcctgtcctgtgtcccagggctgcaggcccgtgttatttgagtccatcaaatcttccgagggcctcggaggaaccattctcagtcaccccaagctctgtaaaaggtcaaaacactggcagcctctcagtgcaccactgtgtgggctccacacgggaaggcctggccaagctgtgctcttagaggctgtcgaggtagggcaggaagcttccctatcctcgtctggatggaatgaaacagaggttccctaaggccaagggactcgtggagcgcccatcccgggtggggtcccagaggtgagtgcagcttgcctnctgtccccaangggcttgttctgtcaggcctcctccagtcactgctggagtgggggctctgactcctgtgttcacctnanagcccatgtncaggctanaggtgaagcttggcaacaacttctactaatacttacctttgngganaaccagtctgnangagganancnctctcanccncagggggagngatgattntntttcaggtncaggattttatttctttnggggaaaaattgcaat

SEQ ID NO: 23074 - DNA, 766 bp, Homo sapiens
  misc_feature 1, 27, 186, 189, 337, 548, 583, 600, 615, 629, 648, 650,702, 707, 709, 715, 717, 728, 729, 734, 740: n = A,T,C or G
nacgacagtagggatgaaatctgatcnagctgacatttgaacaacacgagtttgaactgcgtgggtccagttatatgcagatttctcccaatcaaaaagattttcacacaaccttttccatcaccaagttcctcatcctcaacctggtggatgaaaaatatagtatttatgggatgcgaaacccangcntaaggagggctgatttttgtatcctcagattctgcaaggcttactgtgggtcttgagtatgtgttaatttttttttttaatattgggggaatggaggaattcctggaaccaatcctcttgggatactgagggaagactgtattatcanaaagtgcagatatatgtgaggtgagtgaaaaaacagaaactgcaattgagcagatactagagtaaaatatatcatggaagccacattaatttctagtaaaaataaatgaattataagttgacatacaaaaatgctatacaagttcaagttttgtaatgaaaatgtgggaagctgaaatcccagttcaaactgggagcgtccaacacaaatnagtagaataaaatagaagtgtaatatttgcattanaattcaacatagtaaanataaatctttgtttncaaaacttctaaantaaataagtcaaatattgncncaaaattttcttgacttcctttttttaatttagcggaattcctaagtgactnttagncncccccncncaaaacatgcnnacttnttgctnaaaaattggttattgaagtggaaatt

SEQ ID NO: 23075 - DNA, 176 bp, Homo sapiens
  misc_feature 26, 35, 41, 134, 138, 139, 141, 144, 147, 149, 150, 153,154, 155, 156, 164, 169, 172: n = A,T,C or G
taagggaacgtataaataaaatgacngtttgaacntacaanacccaccccattcctccccacactcatcgcccttaccacgctactcctacctatctccccttttatactaataatcttacaaaaaaaaaactntgannanaangantnnggnnnncctttttnccttntancccc

SEQ ID NO: 23076 - DNA, 730 bp, Homo sapiens
  misc_feature 14, 15, 612, 724: n = A,T,C or G
gggggggacccagnngaatttagcggttacgggttttccacgaccacgctcgcttccaagcacataaactcgtaggaaataagaaaacatggttggaaacagaaaacaatccagaagaagagctacaggggttgtccgtagacgttgctatgctaagtggatgttctcatataatacaccgtactactcaggtaggtttctgtctccgcagcccgtgctgcttaggcgaaacaacagcctgtccgcggaattctgcctgcccaggacagggtccgtggactgtttcttatacaagcgccttgcctccagctagctacccaacagtgtagagaccaccctggtctccccgcagggtcctgcggctcacagccagccaatcgttcacttttgagtctgaagctagagtgatgaccagacgtgaatgcttcctgtgctgacgggaggaacaagctcgcctagccaaaatatcttttgtctttgaggctatgggcctgcaaagagccactaggttttattggagaggccaaagtcttggccttggcttgctccccgcaagccagggcgccacagatcagcggatcgggtcctctgcgaagacgtggaggtcccccnggtctctttgtaaatgagtccagagactaaagtcagaatggcagcttattcttatatacctgaattgtggacccatgctttttgaaacaaaagagtggtttaagggttttgntttaat

SEQ ID NO: 23077 - DNA, 751 bp, Homo sapiens
  misc_feature 20, 21, 28, 181, 574, 627, 630, 664, 682, 683, 687, 709,715, 725, 728, 736, 750: n = A,T,C or G
aggggatattgattttaatnntttgctnaagacatatttattgaatatttatggagagccagtgccaagaattctgagggatatgaaaatgcttgttagtaggctaccatggaacttagtttagtaggtgagaaagtcttgaatgtgaatagctgaacaagtaatacaagttggcagtgtnttatgggtgttacaagtgatgacttaggttcaaaggaataagcagttatttctagctggaggaatcagaaggcttcatggatgtaggacttgaaaggcatcttatggacatattagtagaagatgtactaattggagcaaacaacactgggaaagtcctgatgatttaaagcttctctgatgtatcttaattttattacataaccgatgtttaacaaatgattggattattaatattaccattttttggtcttaaaaagaatattgttgtgttagatgattcagcatagtattgtagttctcaaagtgtgatccttggcagcatcaacatctcctgctaacttgttggaaatgcagattcttggctgaatcccatatctagccgttgagtcanaaagtggtgtgggattcagcaccctgtgctttacaggtcttattttgacaganccncttctacttaatgactacctttttaaaatgcggnactgatgctcacttggcnncccnatgttaaattggatgatacaanataacntgtccctgcncanggtacccncagtttacaaaggnt

SEQ ID NO: 23078 - DNA, 731 bp, Homo sapiens
  misc_feature 534, 560, 614, 625, 626, 628, 629, 640, 641, 643, 649, 650,653, 656, 678, 687, 689, 705, 725: n = A,T,C or G
tagacacaggctgttggttcagagaggaagagttgatctttttacagttaacatgtccctgaaatgaatccatcttctctaaggatcgccattcctgccatggttttggaattcgtaagctcttccttaggcagatgttctcaaactctagtctcagagcctcttcactcagcgattatcgagaaccccaaacagcttttatttatgtagattattagtgatgatattagaaattaaaatggttcacacctgtaattccagcactttgggaagccgaggcaggcggataacttgaggtcaggagtttgagatcagcctggccaacatggtgaaaccctgtctctactaaaaatacaaaaattagccaagcatggtggctggcggctgtaatcccactttctcaggaggctgagacaggagaattgcttgaacccggaaggaagaagttgcagtgagctgagattgtgccactgcactgcagcctgggcttgacagagcaagactctgtccagaaagaaagaaagagagaaaganagagagggaggaagggagggaggaangaaggaaggaaggaaggaagaaggaaggaaggaaggaaggaaggggagagaganaaagaattaanngnnagaaacctttnntnttctgnngcnttnattttaaaaaactataacccantcatgcttngngcgtacaataaacagnatttttttcatttaaaacanattttc

SEQ ID NO: 23079 - DNA, 731 bp, Homo sapiens
  misc_feature 173, 175, 532, 557, 560, 594, 597, 670, 673, 688, 713, 719,720, 725: n = A,T,C or G
ggggggcacccagttttggaactgcagttttaaaagtcataaattgaatgaaaatgatagcaaaggtggaggtttttaaagagctatttataggtccctggacagcatcttttttcaattaggcagcaacctttttgccctatgccgtaacctgtgtctgcaacttcctctantngggaaatagttaagcagattcatagagctgaatgataaaattgtactacgagatgcactgggactcaacgtgaccttatcaagtgagatggagtcttgccctgtctccaaggctggagcccaatggtgtgatcttggctcactgcaacctccacctcccaggttcaaacgtttctcctgcctcagcctcccaagtaactgggattacgggtacccaccaccatgcccagctaattttttgtatttttagtagagatggggtttcaccatggtggccaggcttagtctcaaactcctggcctcatgtctgcctgccttggcctcccaaagtgctgaaattacaggtgtgagccactgngcccggccaacatttcttaacctantantttagtttttatagttttattaccgcagtgaacnctncaccaaaaatttcatttgaattattaacataaaaagaaataattttgtattaaacttttaaactgaattttcnatngcattcccaatcatnttaaatgtttcaccttttacagaanaaactnnatganctttat

SEQ ID NO: 23080 - DNA, 773 bp, Homo sapiens
  misc_feature 17, 31, 178, 179, 557, 588, 647, 658, 679, 687, 689, 701,709, 710, 716, 718, 735, 741, 744, 767, 772: n = A,T,C or G
gggatctgtaggcacantgttgtacagcagnatctctagaacttaattcatcttgcataactaaaattatatgcatttaaaatagttaaactcataaaaacaaatattagaatggtggtttccaaggacttagggaagaggaactggggagttgctaatcaacgagtagtcagttttnntctacggtgaataaaagttgtcaattactatgcccaagtatagatttttggattagggatattcaactggtaagtttaattcaaatattccaaaatcccccaaattcaaaattcaaaacacatttggtcctaagcattttggataagggatactcaacctatatatggttgtacttgaagtagcgaaggaagggagagtaaatttggtgatttagtcctaccatgaaatagcagttacctttctggttctgaggtttctctgccaatacctacaccactgcctccaccaccaaaatggaaaaaaaaaagaaaaaaaagaaactctcaagagatttttctaaagcactatcatacataaattctccaaaagcttggganaaggaaagtgtggaagggaagggatggttanaaatctctcacactaaataggaacagttcatttgataattggaaaaaatgcatagcttnttttgaggacncagctaacctgctgtagtaantcaggaangncaggaattgggnctttgganncctcancnggatcaaaacctaatgngggtanaanaacttactttaggctgggctggnggctnc

SEQ ID NO: 23081 - DNA, 499 bp, Homo sapiens
  misc_feature 439, 452, 474, 481, 484, 485, 488, 489, 490, 491, 492, 493,496, 497, 498: n = A,T,C or G
gaaaggcaaaggatcaaagaaatagagacagggtcttgctctgtcatccaggctggaattcagtggtatgttcatagctgactgtaacctcaaattcattggctcaagagatactcctacctcagcctctggattatctaggactaccggaataaaccctatgcttggctaactttttaattatttgtagaaatgaggtcttgctatatgactacgctggtctcgtacttctggcctcaagtgatcctcccacctctgcctctcaaagtgctgggattataggcatgcgccaccatgccaaagacagtatcctatttcataagaagagggataagggggtagttgtttttttttaacttatctgttaagcatggaacaaggccttataattggttcttgtattccaacacaggattgtttatactacatcctcctgatntttatacctagtngtattagagctaattaacattntttttcngannaannnnnnaannna

SEQ ID NO: 23082 - DNA, 759 bp, Homo sapiens
  misc_feature 4, 643, 649, 656, 671, 688, 705, 740: n = A,T,C or G
aggnatggacaaggctgtgtgatacagacctaaaataccatgttcaaaggagatgtaagcagtggaggctaaactgatgaggaaaggctggagtgagacttgaacaaataggattagataatacatggaataaaggattcagatagtttgagtgaaggatggaagtaggaatgaattaaggctggctgtggtggctcatgcctgttatcccagcactttgggaggccgaggcaggaggattgcttgaagttaggagtgtgagaccagtctgggcaatatagcgagactctgtctctataaaaaatttaaaacattagcaggctgtggtggcatgccagctacttgggaaactgaggtgggaggatcacttgaggttagtgatcaaggctgcagtgagccgtgattgagtactacactccaagcctgggcaacagagtgagaaccatctcttaaaaaacataacggggctgggcacagtggctcacgcctgtaatctcagcacttgaatgctgaggtgggcgggtcgcctgaagtcaggagtttgagaccagcctggccaacccggtgaaaccttgtctctactaaaaaatacaaaattagctgggtgtggtggtgcatgcctgtaatcccagctgaggatgangctgangcatganaattgcttgaattcnggaggtggaggttgcantgagctgaggtcttgcnttgcactccagcctggcatcaggagtgaactcctnttaaaacccaaaacaaaac

SEQ ID NO: 23083 - DNA, 511 bp, Homo sapiens
  misc_feature 399, 402, 403, 448, 454, 455, 456, 467, 470, 472, 487, 491,492, 493, 499, 502, 505: n = A,T,C or G
gggggggtttctccatgttggtcaggctggtcttgaactcccaacctcaggtgatcctcccaccttggcctcccaaagtgctgggattacagtcagtgacccactgtgcccggcctgtatttgtatttttagtagagacagggttttaccatgttggccaggctggtctccaactcctgacctcaggtggtccgcccacctcggcccccagtgtgctaggattgcaggcgtgagctacggtgcctggccagttaatcagttttttaccctcctgtgtttaggccccaacatcctgttcttgatcttttttggcaaaaatttggccaaagattgaaattttgcctcctggaccatatattttgctccagttgcaaagtatgacttttatcctttggtcancanntcccatggtgtttagggcctgaatttgacattctttttttttttntttttnnnatggagtctanctntnttgcccaggctggantgcnnnggcccnatnttngtttgc

SEQ ID NO: 23084 - DNA, 783 bp, Homo sapiens
  misc_feature 1, 9, 47, 660, 679, 738, 765, 772, 777: n = A,T,C or G
nacgacagnaggggatcattccttcatctaccatggctcagccgggnaactctgaacctcaataacgaggttgtgaagatgagaaaagaagtgaagagaattcgagttttagttatccgaaaacttgtcaggagtgttggccgactgaagtcaaaaaagggtactgaagatgcactgttaaaaaaccaaagacgggcgcaaagattgcttgaagaaatccatgccatgaaggaattgaaacctgacatagtaactaaatctgctcttggtgatgatatcaactttgaaaaaatcttcaaaaagccagattctactgcaactgaaagagcaattgccagactagcagtacatcctcttctgaagaaaaagatagatgtgctaaaagctgctgtacaagcctttaaagaagcaagacaaaatgttgctgaagttgagtcatcaaagaatgcttcagaggacaatcattctgagaatactttgtattcaaatgataatggaagtaatttacagcgtgaagcaactgtcatcagtgagcaaaaagtcaaagaaaccaaaatattggcgaagaaaccaatacataattcaaaggaaaaaatagcaaagatggacatggacctaaagcagtgactattgcaaattctcatcaaagccttcagaaangattctgtagtttccttgngtccagaagacacctgctgaccaaactgaaactctagtcaaccaaaaaaaaaaccctgngccgtttttcctaatccaactgaaaancttggtngttgncccccc

SEQ ID NO: 23085 - DNA, 268 bp, Homo sapiens
  misc_feature 1, 9, 14, 17, 24, 117, 128, 134, 143, 144, 147, 148, 149,150, 171, 173, 193, 222, 228, 230, 247, 249, 263, 264: n = A,T,C or G
nacgacagnagggnagnaattggnaccatatgcagcccaatgttcctgttggtatagactatgtgatacctaaaacagggttttactgtaagctgtggttcacttctttttattccnaaatgggaaanaaaaanttttggccnnaannnnaaaaaaatttttttttggagnangccctttctttttttttccnaaaattttaaaaaaaattttttttggaanaaaaantntgggggggggggggggnancccccccccccccnnaaaa

SEQ ID NO: 23086 - DNA, 704 bp, Homo sapiens
  misc_feature 9, 581, 641, 657, 659, 672, 682, 686, 693, 703: n = A,T,C or G
gggtctggnaatagaacaaggaagatctatgtagcacaacaaaaaagttaattggaaactatgattaatggagaagtctatggggtcacgtggaaactgtttaccttgccacctctctgtagtcattaaaactcttgaaaatgaattttcttatcctaagagtgtaaaactgatgttgtggagcattttgcacatgccagacacagatgaattcaagacgcagtccctacactccgggtttctacagtttagctggacagagatgaacaaaattgcaatggagtgtgtaaggggccatagtgtgcaaggcccaacacctccctgagcgaaggacgtcagcactggttggctggatcctggccaagcttgctgtggggaagtggtcgatgtagtgtggggaaggccatttgcactgatggcccctgtggagcggaacattctcatggctgtgtctgttacccaaataactagaggatgctctgtgtgcaaatcttgttttctttaatcagcataaaatctggaatgaggagaaatagcttctgaaatgcgctttctcaaagaaggatgagcagaatgagccncaccatctataccaggagtgtccagttttttggcttccctgggcccattggaagaagaanaattgtcttgggcccncntaaataaactacnctaccaatanctgntgagctnaaaaaaatcnc

SEQ ID NO: 23087 - DNA, 735 bp, Homo sapiens
  misc_feature 546, 568, 624, 631, 649, 725, 731, 734: n = A,T,C or G
gggggtaaccacctgggaaaacttcacagaaaatgagagtttcagatactgagaatagaaccactaagaagcagaaaagagaagatattctcgtgggggagaacaacggctgggaggggaggaagcatggccaaggcaaagagaactgcttcttgctgccgccatatgaagaaggacgtgttcgcttccccttcctccatgattgtaagtttcctgagacctcgccagccatgctgaactgtgagtcaattaaacctctttcctttataaattacccagtctcgagtatgtctttattagcagtgtgagaatggactaatacacctgccatgcctgttccttacttactaaaaaaatttactcccctttctccatagaatgcacgcaatttgaccttatgctacacttccagtctctactcctgcctctttatgctctgtccacatgtgatttctcactattctctacatggcttgtgcccctataaggtttgtgcccttcatttcctgtgccctctacctctggttcccatgctcagaatatcangtgtccttactgcaggggtgtntaagctcagatctcacctcctccatgaagcccctatagacccccagagaggattantaatganccctcctccatgtttccntaaccctgctaggctttctcctgattttttgtttttaggctatgaattaggctttaatctctttaactctaagganaaaaanagng

SEQ ID NO: 23088 - DNA, 702 bp, Homo sapiens
  misc_feature 617, 691, 693: n = A,T,C or G
ggggctgtgatggatttggcaaggttatttgtcattttcacatcagcatggttttggcacctgcttctcagtaaagaattgcactgttggaaactcacttttgacaaagatggtctgcttctgaccaaatggtttatgctacagcagagaaggagaaggatgctgaaccttcagatatcaggccagcattcccaaaagaaagaaggaagaatggtgaaaggcaaaggatcaaaaatagagacagggtcttgctctgtcatccaggctggaattcagtggtatgttcatagctgactgtaacctcaaattcattggctcaagagatactcctacctcagcctctggattatctaggactaccggaataaaccctatgcttggctaactttttaattatttgtagaaatgaggtcttgctatatgactacgctggtctcgtacttctggcctcaagtgatcctcccacctctgcctctcaaagtgctgggattataggcatgcgccaccatgccaaagacagtatcctatttcataagaagagggataagggggtagttgttttttttaacttatctgttaagcatggaacaaggccttataattggttcttgtaattnccaacacaggattggttatactacatcctcctgatatttatacctaagtagtaatagagctaataacatcattntntcagtaaat

SEQ ID NO: 23089 - DNA, 391 bp, Homo sapiens
  misc_feature 2, 9, 332, 334, 345, 347, 355, 361, 362, 364, 365, 367, 368,371, 373, 379, 383, 385, 389, 390: n = A,T,C or G
gncgacagnagggtctgttgttattttcctctgttaaaaaaatatatatctttagatttagattatgtgtttttcatcttgtgcatttaaattttaaaaattatttttccttaagccttttgtaaaggacctttaatcctaaaattgaaccgtaacagcaggaaatatattggtatggggtagatctatgttgtaattatttgtatattggatagttgctaaagactttacttggttttcagttttcttttgaaagccattttaaatagattggtaaaaggttagttggaaaagacattttgagaaatattttgtaaatttttttttttttngnagaagggagtntngctttgtnccccanncnncnnggnangggcangatntnggcnna

SEQ ID NO: 23090 - DNA, 747 bp, Homo sapiens
  misc_feature 12, 677, 679, 685, 688, 693, 720, 734, 746: n = A,T,C or G
gggctacttganagctgaggtgggaggactgcctgacacaaacaggttaaaaagataggctgctccccaaccacccgtgggacagctcaagggcaaatataaacatgctccttcccacaaacaaaagtaattgcaaaaaccccaattacttttgcaccaaccaaataaaaggatggaaaacatacaccatgatacagcttatttttataaaggccagagtggtttattaatatcagacaaggaagattttggaacaataattatttgactatcaataagaaaaagggacatttcaaaataatgaaggaatctattagaaatgggatacaacaatcctaagtgtatacacaccaaatgacagagcttcaaaacaaatgaaataaaaactgataaattaagacttcattacccctctgtcagtaattgttagaaaaagtgtacagaaagtcagtaaggatacaggaaactagacacataccataaaccaacctaagctaattgccatttatagaataccctaaaacagaagtattttcttttcaagcacacacagaatattcaccaaaatcgaccatattttgtcccataactcagatttcaattaatttaaaagtattaaaatctattacgtatatttggagcccagcaaaattaatcagaaatctttacacaagatntntggacnccncaatnttaggaaattaagcaaaacctttcaanaactataggccgantaaaataccaana

SEQ ID NO: 23091 - DNA, 601 bp, Homo sapiens
  misc_feature 217, 218, 226, 228, 231, 238, 239, 244, 248, 270, 277, 280,284, 287, 290, 297, 298, 300, 304, 310, 320, 329, 338, 360,365, 376, 378, 398, 405, 408, 426, 431, 436, 440, 453, 479,491, 496, 504, 517, 519, 523, 542, 546, 569, 572, 575: n = A,T,C or G
  misc_feature 579, 590, 596, 598: n = A,T,C or G
gggattcccagggatttccccatcagtctgtcccttgggttttgcaagctactctgcacctgggctggcctcagttgaaggatcatgcagtagatagaggggaggcagggagagcttgtgggaccttcagtgctgactttagccaccatttccattcccatacaggatgtgaaggtcagaaggcagccaattgttggtttaattttttttttttttnnaaacagtntnttncccaggnnggagngtanggatccagtcacagttcattgnaccctanacnttcnggnctnaaaaaanncncccnccacancctcccaggnagggagtanctggtactncaggtgtgggctgccacccccnactantttttttgtananacggggtttcgttgttcccnggctggnttnaaactcctgggctcaggngaacntcccncctnggcctcccaaagngctgggattcctttttttatttctgnaaatttattttnggggnggcttttngggggaaaattcnangggncccccttcttgctttattngtgnaagggatttgggggttttcccanggnatnggcngctttccccangaactntnttg

SEQ ID NO: 23092 - DNA, 468 bp, Homo sapiens
  misc_feature 293, 303, 319, 340, 345, 372, 376, 382, 402, 405, 423, 427,431, 446, 454, 459, 461, 463, 464, 465: n = A,T,C or G
gggtactataactctgaagtgttttatttgtggtataggctcttgagatctcatggaaataaaccaagaactatttgaagttatttggaagttattttacctttatttagaatatcgtcctttaagttgggaatgttcagttctcccctgggagcacttgtaagcacatatttgttaagcatgtagtgtgtttcagccactgcttgtgttattggagaaacacaggtgatatacaccgctgctggttgctcagtgcttacagttcctatgggagaaaaacactttaaaaatcncatgactcantaagacagtggagcanactcctgtgtctgattgggangtcanaaatttcaaccccggccaggtgctgtngctntgcctntattccaccctttgggaggncgngcgggcgatcccttagtnaggngttnaaaatacttggcgtnggggctcnctgcntncnnnttt

SEQ ID NO: 23093 - DNA, 550 bp, Homo sapiens
  misc_feature 2, 449, 459, 499, 502, 506, 512, 517, 519, 520, 523, 526,536, 539, 544, 545: n = A,T,C or G
gnagtgaagtaaaaagtacatggttccggcaggaaacaggcaaggagagccttgacttgacggagtctggctatatcgccaggctggaatgcaatggcgcgatctctcctcactgcaacctccgcctcccgggttcaagcgattctcctgcctcagcacctcgagtagctgggactacaggcgcgcgccaccacgcccagatgagaaaactgaggcacagagaggtgaaataaggaatgaaatattactggatgaaataattatactgatcctagccttattttaaaagggcccccagaatgctcttctccaagacttagaaaaatcaaatgctatccatccctcaagatacatccctccagcccctccttgaagtctcctgcagctagaagtagaagtagcatctatccccatctggactccttagcactttgctgtacctgccttantccccatctntttacacacacacacacacacacacacacacacacacacncanacanagagtnttatnannctntcncctttatatnacnttatnntattg

SEQ ID NO: 23094 - DNA, 701 bp, Homo sapiens
  misc_feature 4, 510, 563, 575, 576, 581, 589, 607, 619, 635, 644, 646,649, 656, 661, 662, 676, 685, 691, 693: n = A,T,C or G
gggnagcaggcgagccccgtggcagctctgtcacccaatgccttgtcttatccttcttgtaccttccccaagcatggttcgtagcatgtgcgtgcatggttcatagtgtgtgagtactaaggaattaaaaaaacaaaaagtagtagagcaggttgactcttctttaaaaataaacatattgacctgcatggaaggtgaggctgaccctccccattctccattcatcactggattcccagcagggtgtgtgaattcagtggaatgggaagcattgaccaacctctgtgtttctgaagaagtgagagcttttgtaggtgagcagataatgtatttaaatagctctaattttacagtgaaaaacacccacagtgtgacaacatggaaagaatataatcaacttcaacccaatatactcaactccaatcccaattttggcagatagaacaaaaagtcaatacatgttatctgacattaaacagagcttatggaagacagaagtgggtgaggcanataggccgtacttggtcagatccagatgaacaaccagacaaaaataggagtanagccgggtgcanngcttnatgcctgnatcccacactttgggaancggaggcgggangatggcttgagcccanggggtcaanancanccttggnaattnnggagaccctttctntacaaaatntgaaancnctacctag

SEQ ID NO: 23095 - DNA, 612 bp, Homo sapiens
  misc_feature 40, 41, 442, 445, 462, 474, 492, 516, 559, 584, 585, 589,592, 600, 604, 607: n = A,T,C or G
ttcattagtaacttttcagtgacccaaaatggatactttnntggttatataagtataaattagtatattaggtaagggaaagagtttagtgcacctttaaagaaaaaatggttttaattgatgcaccattttattgtatatttctttacatagtgagaagggggcacatgaggtcagcagtcaagttttcaggttaatgtcgtctttgtcacacacctccttttgtgggttggcgatacttttatttatgagctcgaaattctccacttagcacactattaaggtggaaattggaaggctgatatcagtggcctaaacctgaagttctcgtacgttagtaggcatgaataccttgttaagaatctgggccttcatgtaaaaaagattctctacagacccttaggtgaacacggaaatctcaggttttctctctgtagtctanagnatctgaatagccctcanaggacacgtaanaactgttaaaactcaccnccgctcttagttggaggacagaantgcatgcaggactcctttacctatcttgtcctcattctccctntttttttaattctaaaagatcggannaaanttntcctattngaancanacttc

SEQ ID NO: 23096 - DNA, 643 bp, Homo sapiens
  misc_feature 539, 544, 548, 549, 556, 571, 573, 585, 586, 591, 596, 597,613, 615, 628, 636, 640, 641: n = A,T,C or G
ggggaatctttgcacatcaaatttaaccatctgggagaagcagaagaacccataaagaagccagaaggggagaggaaggaggaaagccagatgagagagggtgcttcaagaagccatgggaagagacagttttgtgaaaaaagaactgcttcagattttcagatatcacacaatggtcagataaaacaaagactgaatttgtctgttagatttgacatttaggggcttattggagaccttggcaaaaagaatttcagtggagagctaggagaagaagaaaccaaattccaatggttacaaagtgaaggggagataaattagagatggaatgtgtggacgcttccttcaggaaggatcagagctaatgctagaacggaaaagggggccttactgtctttatcaagaacagagtgataacttgatttttttctatgtaaaagaaacatttatgttttttcttatttaattttatagagactattatgtggttctttgctatgtttccaaaaattattttatgtattgaaattattacccangtaanagtnnaacattnagctgttttaaaganangaattgaattcnnccttnacttnnaccaatggtttttccntnttccacgattgangacttggngatnntt

SEQ ID NO: 23097 - DNA, 723 bp, Homo sapiens
  misc_feature 1, 9, 189, 430, 477, 486, 506, 509, 511, 592, 609, 632, 643,649, 660, 670, 674, 682, 687, 692, 694, 704, 706, 707, 712,714, 716: n = A,T,C or G
nacgacagnaggggatatcatcatttctactttacaattgataaaactgagacataaagagttcaagtgatttatccaacatcccacagcttatagctgatagtagggtcttgaactcaagcattttgagtccaggacctgcatttatgcccactattataatttactacaaatcacttattttatggngtggagttgtcatagtgtgttacgaaaaacataacagctcaatatccttacggcttccaagcttgaagtaaaaattaaaatattttaaaatcacctgttcaatataaaattttttcactgactaattattataatttccccaacattatacacatatacaaatgcccactcaccaaacacacctggcaaggcctttgaaatgtgtatccaagcctcaaaaacagacaatgctgttcaaggngacaccatgagaacaggaacattcatgtggcctctgcttgaaaattnctgtctcangatgcacaccaccttaaaangcngntaatttcattttcaagccactctaaccattcaaaagccttaattgctgattagcatgaaagttaaattactgaaattgggntgcattctgattcttgntagtcacagctttttagttagtncttacccaagntattcncctccctaaangggtttaaanaaantcctatgntggcngggcntnggaaaacacngnnccaantncncctttct

SEQ ID NO: 23098 - DNA, 723 bp, Homo sapiens
  misc_feature 19, 551, 572, 614, 645, 647, 672, 673, 688, 689, 690, 691,694, 697, 700, 703, 717, 719, 720, 721, 722: n = A,T,C or G
ggggaccacgtaacatgtngtaggaggttccacatcagcatcgacagcagtggcagaaacgtcaggccgtagccgaagcctcggaaggagcggcccacggcaaagagacatggtcttgctatgttgccagtctgggctcaaacttctggccttgagtgattctctcacctcagactcctgagtagctgggattacagatgcgggccaccacacctggctgtacaaactttaaaatgtttgagcaaattcaatgagtatagtaaaatatcttcctccctttaccgattcccaccctattctcccccacccccaccccaggcatcaatattatggtttcttgtgcactgagtgattttttaaattattattatttttttatttttgagacagagtctctctctgtcacccaggctggagtgcagtggtgcgatctcagctcactgcaacctccgccttccgggttcaagcaattctcctgcctcagcctcctgagtagctgagactaccggcgcccgccaccatgcctggctatttttttgtatttttagtanagatgggggttcactcgagangggctcaatcttctgacctgatgatccgcctgccttgggctnccaagggctgggatacaagcgtgagcccccncncctggcctatttttttttttttaannataaaagggggtttnnnnccnggnggnggngggggggcccccantnnnng

SEQ ID NO: 23099 - DNA, 704 bp, Homo sapiens
  misc_feature 2, 9, 38, 537, 563, 572, 587, 593, 608, 622, 654, 655, 663,669, 674, 675, 677, 683, 685, 690, 696, 702: n = A,T,C or G
gnagacagnaggggtctgctcataggggagcttctagnaaggaaggacttattgtcttagttacttgatccacttccttacctcctgttcatgcaactttgcttgttttgcttctactaaaatggttctaggtgctgtgtggacaggtgatacaaaagcctcactcacacggttgacattcattcattccattttcatttctctttgagtgatcctgacaagcagagggtctcaggtggatattactgtgtctttgagacctctctaatccttatctatctctcattttaatacagagagtttcatacgcagaccttaagtagacatagtatccagctaaaagggtctcactctgtcacccaggctggagtgcagtggcgcagtcatggctccctgtaacctcaacctctcagactccagcaatcctcctgcgacagagacagagtctcactttgttgctcaggctggagtgcattggcacaatcttggctccctgcaacctccgcctcccagggttgagcgattcttttgcctcancctcctgagtatctgggatgacaggngcctgcccnaagtctcttttgccntataanggaggcagtcaaggngaatgctgggcttnctgattactccctggagacctttctgaggatnngttttctnatttanaaaanngncactgncngaccnctgaanaaaaanaa

SEQ ID NO: 23100 - DNA, 736 bp, Homo sapiens
  misc_feature 469, 518, 550, 556, 592, 600, 607, 618, 623, 647, 648, 667,681, 684, 687, 694, 700, 705, 717, 718: n = A,T,C or G
aggggcgtcatggggatttggcagcgtctgctgctttttggtggggtgtcgctccgggctggtggcggggccactgccccgcttgggggaagccgagcgatggtttgtgggcgccagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcagtgaatcttgcacttgcactagctgcgaacgattcgtccaaggccattggtttgctagatgtggatgtgtatggaccttcagttccaaagatgatgaatctgaaaggaaatccggaattatcacagagcaacctaatgaggcctctcttgaattatggtattgcttgtatgtctatgggctttctggttgaagaaagtgaaccantagtttggagaagccttatggtaatgtccgccattgagaaattgttgangcaggtagattggggtcaactggactacttanttgtanacatgtcaccaggaactggagatgtgcagttatcantctcacanaatattnctataacaggngctgngattggctcccccccccaggacannccattgtggaatctctgtntttttcactgctgnaanctncattttntcaaanaaaanaaagttaaaaannaaaaaaaaaaaaaaaaaa

SEQ ID NO: 23101 - DNA, 715 bp, Homo sapiens
  misc_feature 5, 607, 639, 649, 656, 662: n = A,T,C or G
ggggnagcggtggaggagcgggcgccatggcggttctactggagaccactttaggcgacgtcgtcatcgacttgtacaccgaagaacggccgcgtgcctgcttgaatttcttgaaactgtgcaaaataaaatattacaattattgccttattcacaatgtacagagggattttatcatacaaactggcgatcctacagggactggccgtggaggagagtctatctttggccaactgtatggtgatcaagcaagctttttttgaggcagaaaaagtcccaagaattaagcacaagaagaaaggcacagtgtccatggtgaataatggcagtgatcaacatggatctcagtttcttatcaccacaggagaaaatctagattatcttgatggtgtccatacggtgtttggtgaggtgacagaaggcatggacataattaagaaaattaatgagacctttgttgacaaggactttgtaccatatcaggatatcaggataaatcatacggtgattttagatgatccatttgatgaccctcctgatttattaatccctgatcgatcaccagaacctacaagggaacaattagatagtggtcgaataggagcanatgaagaattgatgatttcaaaggaagatcanctgagaagtnaaaaatnaaggcngaaaagaggcttaaactcaggctttcttttggagatgggggagacctactgag

SEQ ID NO: 23102 - DNA, 458 bp, Homo sapiens
  misc_feature 4, 445, 447, 450, 451, 454, 456, 457: n = A,T,C or G
gggnagcatgttgggccttttggatagattctgtgagtccttctttctacctttgcttgtagataagattttccttgaatacaaacacacacactctctctgctttttaaaaaattagttttggggctggatgtagtggcttacacctgtagtcccaggcactttgggaggccgaggcaggcggatcacttgaggtcaggagttccagaccagcctggccaacgtggtgaaaccccgtctctactaaaaatacaaaaagtagctgaatgtggtggtgtgcacctgtagtcccagctgctcaggaggctgaggcaggagactggcttgaacccgggtggcagatgttgcagtgagccgaaatcacaccactgtactccagcctggtgacagagccagactgttttaaaataaataaaaataaaaaattggttttggattttaaaananaannaananna

SEQ ID NO: 23103 - DNA, 742 bp, Homo sapiens
  misc_feature 11, 39, 121, 195, 237, 357, 369, 472, 484, 498, 507, 544,564, 593, 600, 610, 618, 639, 641, 652, 658, 661, 663, 714,721, 722, 728, 733, 734: n = A,T,C or G
ggggtacactnaaactcccacagaaagggggaaaattanaaaaggggtgatataatttgactctatgtcaccacccaaatctcatcttgaattgtaatccccgtaatttctcacctggcangtagtgggaccaggtggagacaattggatcatgggggcagttttccccatgctcttctcgtgataatgattgantctcatgggatctgatgattctataagtgtctggcttttctnctacttgcactcactccatcctgccaccctgcgaggaaggtgcctgcttcttctttgccttccgccgtgagtgtgagtctcctgaggcctccccagcaatgtggaactgatacgtcatgnaacagagggcancctgcctcctggaaatgtggagtgtctagggagtcacagctgagatcttccttggattaaaggctgcgggtgtcacatacaggatgctgtaacaacaccatanactttcaaacanctctatttcctacngttctggangctggaagtccacaatcaaagtgtcatgttgtcaggntgtggtgagggccctctttngggtgtagattgctaacttttctgtatgngttcacntggcaaaaanaaattganctacctcttggatcctttttntnagggcaccaancccaancanangctttactctcatgacataattgtctccccaagactctacctccaaaattntcaatcnncccttnggggnngatttaac

SEQ ID NO: 23104 - DNA, 813 bp, Homo sapiens
  misc_feature 7, 8, 11, 14, 18, 19, 24, 30, 41, 43, 44, 51, 62, 65, 72,98, 681, 708, 718, 742, 756, 765, 770, 777, 789, 798, 805: n = A,T,C or G
ttttttnnctncgntaanncttgnttgttncttttggccgnanncggcctncggctgcgagnagncgacagnagggtaggcgcatatttttttaaagnacagtagttagttccaaatatattattttatggatgaacaatttaatctaaaggggactatatcaggatattggaatcacttattggaccgtaagaattgaaacctagatcaaataaatttgagtagaaggaaaaggtaagagaatgacacaaaaagcacccagaggagagtatttctgtgtaaacaggtaaattaataggtggatatttaatacacaaattcacatttgtttcaagattggccttgtgtgtatggatactaaaaaggaaataacgctaatgcttcattcatttttttattccaaataattttgctaagccccattacatagccaactcactgttagacactttgttttaaaggtgaaagagttaatacatttgcttccaaagaacttactagtaaagttacacacacacacacacacactcacacacacacacatacacacacagagaatgagagagagaattacgtattctataggaaataaaggtaatatagaaaatctaaactaccattcaactgtaaattttttaaaaaggaggtattttacttatacaattttgagtggtaaaaaangaacatcttcaaataatgagtctaaanaataatgcangttgtccgggtgtgggggctcacncctggaatcccacnctttgggangctgngcgggcnggatcacaaggnaggggatcnaaccctnctggctaa

SEQ ID NO: 23105 - DNA, 708 bp, Homo sapiens
  misc_feature 2, 9, 11, 50, 607, 637, 659, 679, 692, 704: n = A,T,C or G
gnagacagnanggggagagctgcaaggccacaagtcccagggcctctggnaagctgtcactgcctctgaaatccttgcagaaggctttcagccttacaaggcctgtgggtgagaccttgccccagaccatgggctccttcagcctcactcttcctggtatctctgggctgggcacagaggaacatcagggtgaacgaatgaatgaacagacaatgcacacatcactgggtgatcttggagaaggtgcctctgctccctcacatgatctgtgacacccagatttggcaaggcccatagcagtgagtgttgtataagttttgccatcctggtcctgaagcagggcccagcttggtgctgtgagaaacagcccacctttttgttacctcctgtgtctctatgaaggaggactggaagaaaccctactgacagggcctatcatcttaaaggaatattttgggctgggcgcggtggctcatgcctataatcccagcactttgggaagccgaggcaggcggatcatctgaggtcagtagttcaagaccagcctggccaacatggtgacaacccgtctctacttaaaaaatacaaaaattaggctgggcgcggnggctcgcctgtaatcccagcactttgggangccaaggcgggcggatcacgangtcaggagatcgaaaccatnctggctaacaagngaaacccctctntact

SEQ ID NO: 23106 - DNA, 737 bp, Homo sapiens
  misc_feature 1, 9, 33, 657, 671, 689, 701, 732: n = A,T,C or G
nacgacagnaggggacgtgcaggcagcggcggntcattccttcatctaccatggctcagccgggaactctgaacctcaataacgaggttgtgaagatgagaaaagaagtgaagagaattcgagttttagttatccgaaaacttgtcaggagtgttggccgactgaagtcaaaaaagggtactgaagatgcactgttaaaaaaccaaagacgggcgcaaagattgcttgaagaaatccatgccatgaaggaattgaaacctgacatagtaactaaatctgctcttggtgatgatatcaactttgaaaaaatcttcaaaaagccagattctactgcaactgaaagagcaattgccagactagcagtacatcctcttctgaagaaaaagatagatgtgctaaaagctgctgtacaagcctttaaagaagcaagacaaaatgttgcttgaagttgagtcatcaaagaatgcttcagaggacaatcattctgagaatactttgtattcaaatgataatggaagtaatttacagcgtgaagcaactgtcatcagtgagcaaaaagtcaaagaaaccaaaatattggcgaagaaaccatacataattcaaaggaaaaatagcaaagatggacatggacctaaagcagtgactattgcaattctncatcaagccttcanaaaggattctgtagtttnccttgagtccanaaacacctgctgacccaactgaaactttagncaccc

SEQ ID NO: 23107 - DNA, 832 bp, Homo sapiens
  misc_feature 2, 12, 15, 19, 20, 32, 43, 45, 61, 64, 71, 760, 794, 817: n = A,T,C or G
antcttgacctncgntaanncttgtcttgttncttttggccgnancggccacggctgcganagnagacagnaggggatgatgatttttccatttacttgtttcatctctgatttctttcagcagtgttttctttttctccttgtggagatattatacttaatacatagcccacaagcactatgaaggaaactacacaatcaagtctacgtaacagccagctaacaacatgatgacagatcaaaatcatacatcttatactaatcttgaatgtaaatgcacttaataccccacttaaaagacacagagtggcagctagataaaaagacaagacacaaacataggttgtcttcaacagacccatctcgtaggtaacgacacccataggttcagagttaaaagggtggaataagatctaccatgcaaatgggggggaagagggagcaagagttgctattttcatatcagataaaacataccttaaaccaataaaaattaagaaggacaatgaaggccattacacaatgataaagggtacaatccaacaagaagccttaactattctaaatttatatgcaccaaaattggagcacccagattcataaaacaacttctttttggcctgtgaaaagactaagacactacacaatagtagagggagacttcatacccaattgactggtagatcatcgagggaaaatctaacaaagaaactctagacctaactcgcatttgaccaatggaccaatagaatctacgaanttatgctgataccacagattttctctctctaccncgactatttggatgcccctgctngcctaagcggcctaa

SEQ ID NO: 23108 - DNA, 775 bp, Homo sapiens
  misc_feature 5, 11, 12, 15, 16, 17, 18, 30, 43, 44, 61, 70, 92, 269, 280,283, 296, 301, 307, 310, 316, 321, 323, 328, 345, 354, 364,366, 380, 386, 395, 413, 416, 421, 423, 430, 431, 440, 446,448, 455, 468, 481, 499, 512, 527, 540, 545, 550: n = A,T,C or G
  misc_feature 569, 570, 577, 579, 584, 590, 599, 602, 619, 644, 650, 667,672, 693, 699, 702, 704, 725, 730, 736, 744, 756, 761, 765,767, 768, 769: n = A,T,C or G
ttttnacctannatnnnncttgtcttgttncttttggccgcanncggcccacggctgcganaacgacagnaaggggagttccgccgctgggnactacagcgtttggctgcacggggagttctcgtatgtctagaacgatggcctttctgcggtgtctgcgaccgggaccaaggcggagcaaagtcgccgggggtgtggggtgttccacgctatgttgggagtgttcgctttcgaggtacacgactacgttctaaatttttttttttttnaaacagtttcnttnttgttgcccaggnttgantgcaanggngcagtntccgntnacagnaacctccgccgcccggnttcaggcanttgtcccgtntnaccctcccaagtanctgganttacaggcntgccccaccacccccggnttntttcntntttttannaaaaacggntttccncntgttggncaggctggtctgnaactcctgacctnaagtgatccacctggctnagcttaccgaagngctgaaattccgggngtgagccaccgcncctanccctntaaacttttaaataatcgnnaaatgtntncccanctgaancaaattcanctntttcctctaccttttgnggggaatttaaaatactgaacttgngaaatnaacctggggggcaccanttctnaaactttttggtcacaggacncttgcnctntnttaaaatgtactgaggacccnaaaanctttgnccactggnggttactcctgnttttnccancnnnaaataa

SEQ ID NO: 23109 - DNA, 813 bp, Homo sapiens
  misc_feature 1, 8, 22, 30, 43, 558, 622, 681, 689, 693, 700, 702, 707,729, 736, 750, 772, 776, 781, 793, 795, 800, 806, 807, 808: n = A,T,C or G
ncggcctncggctgcgagtagnacgacagnagggagccctggntcaaacttgcactagcatacaggtggtgtgataatctctttaccttgacagcaacataagtctgggcttgtgagatgaatggtaggacttcatcaagatgttgtccagctactcagtgtgcatcatccattatgccccagccaaggagatcacaaaactggctccacctctcatcacttctaagaaaacttcccccagtcttctcttgtgcctaaacaactgtaatttttatagtcatgtgttacatactatgccagatatatgccaacgaatgtctataaaaaaaagttaatatttattagccagaaagcataatgttagattttggcttttagaaggggaggttttattgatccacctacacattggcatgtgaatttacttctccatgaaagcagagaagaaatttattaatttatttgaacagctttgtcaacattgttctgaaaagaacaagttggaatgtagtagcagtgtgctccattatgacaaaagctttgcaaatgacacaaaangttatcagagttgaccattaaggaccatatggcaccaggcttcaggaaagatacagtggagganggagaacagagaccccatccttacctgcccatcagggagttaccctgggatggggaggngcaggcgnatanctgaccntncttcntctactggggagttggactggnttgctgnggctgaaagctttnactgtgacaaggatgactgtcnattnttttntttaaaacattntnccttnaaactnnntttaa

SEQ ID NO: 23110 - DNA, 846 bp, Homo sapiens
  misc_feature 7, 13, 18, 19, 30, 43, 50, 60, 63, 71, 794, 808, 811, 815,818, 840, 842, 844, 845: n = A,T,C or G
tttttgncctacnatacnncttgcttgttncttttggccgcancggcctncggctgcganagnacgacagnagggtgtcttatgcctgtaatctcagcactttgggatgggaggccaaggtgggcagatcacttgagctcaagagtttgagaccagcctgggcaacatgacaaaaccccatctctacaaaaaatacaaaaattatccaggcatggtggcatgtgcctttagtcccagctatctgggggctgaggcgagaggattacttgagctcaggaggtcaaggctacaatgagccatgatcatgccactgcactctagcctgggtgacagagtgagaacctgtctcaaaatgataataaataaataaataaataaataaaacttatctgcatcagaagataccacctccccacccaacaaaaacatgattgaattgtttgggataatgtattttcaattcatagaaatagacacagaattagtaatacagaaggaactccatatatatatatgtatataaagaaggccaggtgtagtggcccacacgtgtaatcccagcactttgggaggccaaggtgggaggatccttgaggccaggagttccagaccagccttggcaacataatgaagccctctacaaaattacaaaaattagccagacctggtggtgcacatctgtagtcccagctactcaggaggctgaagtgggaggatcacttgacccagagtttgaggctgcagtgatctatgattgcaccctattttcagcctgacacaaacagacccctttntttaaaaaaaaaanaancctnttngaaaaaaaaaaaaaaaacccgngncnnt

SEQ ID NO: 23111 - DNA, 849 bp, Homo sapiens
  misc_feature 3, 12, 15, 19, 20, 32, 43, 46, 53, 62, 64, 67, 75, 83, 90,91, 199, 722, 735, 740, 755, 772, 777, 789, 792, 802, 815,828, 834: n = A,T,C or G
ttnttggacctncgntaanncttgtcttgttncttttggccgnagncggcctncggctgcgngnagnacgacagnaggggagnaaccagnntctccaggtgtgaagtaagcaatctattttcacttgctattaacagcaaacgtacaactttatctcttatttgacttcattatttggctttcaaattaacaacatganaaactatacagaaattagtctgtgccctataagacagagatttagataatttgttcaaaacatgagatgatattcagatattctctcaaaggcaggactccaacaccgcaggtggaaaaccaacaaaaggaagaaaacagaaaggaggaaagggaagatgaaagaccgacttcaagaactaaagcagagaacaaaggaaattgaactctctagagacagtcatgtatcaactacagaaacagaggaacaaggggtgtttctacagcaagctgttatttatgaaagagagcctgtagctgagagacacctacatgaaatccaaaaactacaggaaagtattaacaatttggcagataatgttcaaaaatttgggcagcaacagaaaagtctggtggcttcatgagaaggtttagtctacttaagagagagtctaccattacaaaggagataaaattcagcagaatacatcaccagaagtttgaatgatttagtaaagaagttaaaaagtcagaggtgaaatggnccatcttcatggncacangatacttaatctcanatgctgcatgttccgcnttttnagcaatctgttnttncatgaccatngcgcaagcagganagggcagaatttntttcgnagcttggagtgctgg

SEQ ID NO: 23112 - DNA, 768 bp, Homo sapiens
  misc_feature 1, 2, 10, 12, 17, 539, 565, 579, 613, 649, 671, 689, 696,712, 713, 716, 726, 729, 731, 732, 741, 743, 754, 759, 761,763, 766: n = A,T,C or G
nnacgacagnanggagnaaatttaaattttgatgaagttctgtttgtctattttttcctttggttacacatgcaatttttaaattaaaagtaaatttccagtaaaatttacttgttttggagtgtaaagctatgtggattttaacacttgcatagatttgtgtatctaccaccaaaatcaggatacacccaaatcaggatacagaaaattttcatcatcctccaaaattcctttatactcctccatttgcaggcaaactcttgatccctggttggcaatgacctgttctttatccccatggttttgcctttccaaaaatgacatataaatggaaccacatatagtgagataattctccatgggtctcgcattgctgcatgttttacaagcagggacactgactgtttttgttccagactatcattttgagaatgtttgaatagtgaatagccttggaagatatagtatgtttctccctctgaagcaaatgggaggcatactcactgcccattataaaagatttgagttttctgagatanggttcttctcctgtacaagtcatggnatgtatctcttggntctcttcaccttgccctttgggaatggggctcanggcaccagcactctacaaagtgctgatagtctgacnaatctgttgctgtcaaaaaagngggaggaatggtttgcanttgaganctggaaaaactgaaanntgnaaaaagaaanaangnnctgggaagngnatttttttaanaaaancngnggnca

SEQ ID NO: 23113 - DNA, 519 bp, Homo sapiens
  misc_feature 20, 23, 26, 27, 29, 30, 36, 44, 49, 58, 68, 74, 80, 92, 408,483, 492, 493, 494, 495, 496, 497, 499, 500, 504, 505, 506,510, 512, 514, 516, 518: n = A,T,C or G
taaactggacctaacgatanaanctnngnnttgttncttttggncacgnaacggcctnacggctgcgnataatngacagnaaggtatcgggnatgttcaatgcagtactgttcttgcagtagtaaacaattggaaacataaatgtcccttaggggatttgtggaataaattatcatgcattcttcttataaaaactagggccagtcgcagtggcttacgcctgtaatcccagcactttgggaggccgaggcaggtggattgcctgaggtcaggagtttgagaccagtctggccaacatggtgaaaccccgtctctactaaaaatacaaaaaaattagctgggcgtggtggcatgcacctgtgatcccagttactcaggaggctgaggcaggggaattgcttgaaccanagaggtggaggttgcggtgagccgagatcacgccacagcactccagcctggcaacagagcgagactctgtctcanaaaaaaaannnnnnannaaannnaccnancntngnc

SEQ ID NO: 23114 - DNA, 770 bp, Homo sapiens
  misc_feature 2, 9, 51, 501, 547, 566, 625, 668, 674, 675, 680, 694, 695,707, 722, 730, 734, 747, 748, 755, 757, 768: n = A,T,C or G
gncgacagnagggataaagtatttttagtaatttaaacgttatataacagnatatccgttgattcctttgtttctacgtaaataagtatacttgagatattcagtaaacagtattgaatacatgtttcatttgtataatataaaattatgattattctttttaaacagtacatcatatttgcttgttggctttatgataacttagaaataatattctggattaactgtgtgactcatgagaagatttgtgcaactatgtttccaaatttacttgattttcaagacttacactagaactgtgagaacagggtaataaataagcatatgtattaatatcacctttggtcaactcttgggtagccccaacggtagtgtaggaattaacgtaatttttcctactaaaagtattggatttgttttgagagaccacagttgaaaatcattgacatacaaagtttaaaaattgttaggttaaaaaattttaaatgcatttgaagtggntttatagaaaaataattatctaacttggtttatattgacaggttgntttcttggataagacctanacgaagagaaaggagattagtgataaatgtccaggtttcaagttgaaagtacattcagngattacaccgatggtgggatgtcaattccaatgctgaaacgtnttgtannctgtncccgagtatctacnngcaagacggaangcctccaataggaanaggtgggngcgnggcccctctggtnntggaccncnccttgggtcangc

SEQ ID NO: 23115 - DNA, 525 bp, Homo sapiens
  misc_feature 90, 118, 120, 121, 122, 123, 124, 125, 126, 127, 128, 129,132, 138, 145, 147, 149, 151, 159, 175, 181, 205, 207, 212,213, 214, 215, 222, 224, 226, 231, 239, 240, 241, 245, 247,258, 259, 261, 266, 267, 269, 270, 277, 282, 289, 303: n = A,T,C or G
  misc_feature 308, 321, 341, 342, 357, 362, 367, 393, 404, 418, 421, 424,429, 448, 449, 451, 466, 467, 469, 490, 493, 501, 502, 504,512: n = A,T,C or G
tatctttgtagtctcattcacagaattcctaatcccccgcaacccggaggctgtaaaaatgaggataaggggttagaaaattttccaagnaagtgactggttggtttttaaaagaaantnnnnnnnnnnaancccctnttttttngngnanaggggggncccgccccaaattagngagttngaaattttggggttttctttaaanangcctnnnnccttttngnantcccnaggggtcnnntttntnccccccgaatnntnaaaanntnnggggatnccctntaaaaangtagaaaaatttgngtttnttttccccctttnttaaaaaaacccgggggggnnttttaatgggggggnccctnttttngtttttgccccccccctttttaaaanggggggatttnttttattttttgcnccnttnaaaanaaaaaagaaagcccctttnntnaccctcccccccccnngnaaaaaaaaaaaaaattttttntgnaaaggagnngnggcccccncttttggggggcc

SEQ ID NO: 23116 - DNA, 767 bp, Homo sapiens
  misc_feature 599, 602, 615, 641, 650, 658, 660, 692, 702, 705, 706, 733,734, 746, 747, 759: n = A,T,C or G
gggtccacaagggttttatttttaaaagtctacttcttccctacaatatagaacttccagaaaaggagctgactcccatgaagggcaagcagagccaaaagcaagtactatgcaagtgaagactactttctaatcaagattttacaaatatatttctttttttttgagacggagtctcgctttgtcccccaggctagagtgcagtggtgccatctcggctcactgcaacctccaccccccaggttcaagcaattctgtctcagcctcctgagtagctgggattacagtgaccgccactacgcctggctaatttttttgtatttttagtagagacggttttcaccatttgagccagacttgtcttgaactcctgaccttgtgatctgcccgcttcagcctcccaaggtgctgggattacaggcatgagccaccgcacggggctgagattatataaatatatttcaaggaataggaagctgttattcccatgtgttgccttctctaaagaacatcagctgtgattaaatgtcctttcagtggagaaattttcactgctccaagtcaaagcagatatacttttaacaaatgatttatcctgngtntttaatatccaanacatattcttaccgctttattctggnctgctgggnggactgantntcaggactatgcgtcactgctgagggcttatnaggaccttgnagnnactatttaagcttttgggtgaagcccnnggtaaaaaattnntgactttataanttactttg

SEQ ID NO: 23117 - DNA, 764 bp, Homo sapiens
  misc_feature 9, 10, 11, 12, 15, 20, 23, 34, 35, 38, 39, 47, 58, 60, 67,79, 87, 89, 653, 659, 665, 668, 683, 691, 692, 694, 706,719, 721, 722, 737, 750, 753, 756, 757, 760: n = A,T,C or G
gttttttannnngantaacntgncctacgataannctnntcttgttncttttggccgnancggcctncggctgcgatantcgacagnanggggtactcttgtggcaaaactgctggcaagtgtaccctttctgcagaaagtaaaaatggccttgctgaggaaattaaatttatgttcaagtgctatcctttacagcaccagggaacaagcatttctaacaatagcttatatttactacttaatgtttgatttacttttattgcaaataaggtcaaatcaaacatttacaaactggtacaataatacttttttgtaattagatatacaccaattcatactgacaatataacaaataattgtaatattcagttctagtattctactcaccacaaatccaacatttatttttccttctctattcttcctgctgaaaatgttaatctcttcagacaattatttgctatgaattcaaataactgctccaatctaataattgttcatataattcatcttaaatgatacaggtgaaataattttctcttatggctgacataagacagtctttaattacaaaaacaattaccataaaaaattgtggccattatttccataactatctttctttctcctcccttccacttctgggacttcanttgcangtttgntanactgcctgatgttgnctcaccanncnttgaggctctgnttattttgctttnanncacttttctctctgngcttattctgganttntgnngcnttga

SEQ ID NO: 23118 - DNA, 768 bp, Homo sapiens
  misc_feature 2, 23, 24, 30, 36, 47, 49, 50, 59, 61, 625, 640, 663, 678,693, 694, 706, 709, 722, 737, 742, 743, 747, 748, 751, 759,763, 764: n = A,T,C or G
anataacttgacctaacgataannctcgtnttgttncttttggccgnanntacgacagnanggggtactcttgtggcaaaactgctggcaagtgtaccctttctgcagaaagtaaaaatggccttgctgaggaaattaaatttatgttcaagtgctatcctttacagcaccagggaacaagcatttctaacaatagcttatatttactacttaatgattgatttacttttattgcaaataaggtcaaatcaaacatttacaaactggtacaataatacttttttgtaattagatatacaccaattcatactgacaatataacaaataattgtaatattcagttctagtattctactcaccacaaatccaacatttatttttccttctctattcttcctgctgaaaatgttaatctcttcagacaattatttgctatgaattcaaataactgctccaatctaataattgttcatataattcatcttaaatgatacaggtgaaataattttctcttatggctgacataagacagtctttaattacaaaaacaattaccataaaaaattgtggccattatttccataactatctttctttctcctcccttccacttctgggacttcanttgcaggtttgttanactgcctgatgttgtctcaccantcattgaggctctgnttattttgctttcanncacttttctctntgngcttattctggantttctggtgcttganttaannttannggncttctttntgcnnactg

SEQ ID NO: 23119 - DNA, 724 bp, Homo sapiens
  misc_feature 2, 3, 13, 16, 20, 21, 25, 27, 33, 44, 46, 521, 539, 573,618, 635, 658, 686, 700, 724: n = A,T,C or G
anntcttgacctncgntaanncttntnttgttncttttggccgnanagtcccagggcctctgggaagctgtcactgcctctgaaatccttgcagaaggctttcagccttacaaggcctgtgggtgagaccttgccccagaccatgggctccttcagcctcactctgcctggtatctctgggctgggcacagaggaacatcagggtgaacgaatgaatgaacagacaatgcacacatcactgggtgatcttggagaaggtgcctctgctccctcacatgatctgtgacacccagatttggcaaggcccatagcagtgagtgttgtataagttttgccatcctggtcctgaatcagggcccagcttggtgctgtgagaaacagcccacctttttgttacctcctgtgtctctatgaaggaggactggaagaaaccctactgacagggcctatcatcttaaaggaatattttgggctgggcgcggtggctcatgcctataatcccagcactttgggaagccgangcaggcggatcatctgangtcagtagttcaagaccagcctggccaacatggngacaacccgtctctacttaaaaatacaaaattaagctggcgcggngctcgcctgtaatccancactttgggaggccaaggcggcngatcacgaggcaggaaatcgaaaccatnctggctaacaaggngaaacccatctctcttaaagtccn

SEQ ID NO: 23120 - DNA, 591 bp, Homo sapiens
  misc_feature 2, 4, 10, 11, 14, 22, 23, 27, 45, 47, 53, 55, 470, 495, 501,534, 536, 543, 548, 549, 553, 557, 563, 564, 574, 578, 586,587, 588, 589: n = A,T,C or G
antnacttgnnctncgataganncttntttgttgcttttggccgnangacagnangggagctttactcattcctcttcctgttgagttttgaatgatttcccattgcctaaggggtgaaatcccaaactctgtgacttagcgttaacctctatcagctctgtccttagccagtgtactaatttaccctgaataactttgttaccccgtctttccctgacttcccaagtaaagaattgtttcttcttcaggttgccatagcagttgatgcggttctgtagtaggcacctgtcacggtgtaaaggtgatgcaccgtgacaggtgctctgcttgtttccttcgtctttgtattcccaatgcttagtgcttttgttgacacatactaggggttcagtaagattaaattgcagtatctgcccaagagaaatgagaacaaatgtccacattaaaacttgtacatgaggctggtggnggggggctcatgccagtaatcccancacttngggaggccaaggcaggagaattacttgaggccnanagttcangaccnncccnagcnacatanngaggccctcntctntacaaaannnnaa

SEQ ID NO: 23121 - DNA, 810 bp, Homo sapiens
  misc_feature 3, 10, 11, 22, 23, 24, 25, 29, 32, 38, 51, 52, 60, 62, 65,74, 612, 647, 650, 691, 697, 699, 729, 732, 738, 743, 747,754, 763, 769, 778, 783, 790, 805: n = A,T,C or G
gantaaacgnngtttacgatannnncttngtnttgttncttttggcacganntcgacagnanggnaggaggagnagtatgaatcagcaggtatgaagtaactcacaatttaggctataggggccacatttttctaacttaatattccatgattatttccaaaggttacttaaatccaatatatgactcagagcttcagacttaacgtcatacattttcacataggttttaatttgtggagaaaggacatattctgatattattatagaaaagccattggattctgtggtgtgataataagagatttcaggtctgggtcttctttatcagtcagcttttgtattgcaataacctacgatctcaattctcaaaggcttagagcaagatcatttgctttttgttcatctgaggactggcgggtgagtttgggttggctgggctcagtttcactgggcttttggttccaggagcccagagtgaagcagcagccactatcctgcagttttcaacgcagaggacataccaggggagacagaggctgagccaaatcaaataatcacattgaaaccttttgcttaatcataccaatgtcatggctgctcatatgcattanccaaagcagccacatgacttggcagaagttcatanggntctgatgcttattcctccctagaatgaacaggattctcatntaactngnattgactatttcaaatcccttgctggaagnggngaatanctggnaaantaatccnctggtttcntttccnccaatgatnggcangtttcanttccactggcaaaanaggcc

SEQ ID NO: 23122 - DNA, 790 bp, Homo sapiens
  misc_feature 1, 8, 18, 21, 28, 55, 518, 655, 659, 671, 678, 683, 689,700, 740, 746, 748, 756, 765, 776, 788: n = A,T,C or G
ncggcctncggctgcganagncgacagnagggtacgagcagttcatctttgcagntcataccaatatgattcacgttgaaaatgtctatgaggagattttacatcagatcctgcttgatgaaactctgaaaggtaagaaaggttacctggtgctgcagggacactccatagaggggagcatccctgaaataggactcggtaaggccagtcagggaggaaaagagaagaggaaatggacattggtgagggagggagacagacagtgaggagagggaaggaaagaaggaaggatactaaccttgattgagtgttatgattaagcacacacaaagctggcactttagatgttattttccctttttaatacacaaatatgaatgctgtgagatgggaattttaagtttcattttacagatgagaaagttgaggcttagtgagattaaatctcgggtctctcatgaagagctgtcttcctcttgctattccagacagaacaaagggaaaagggcttttcttangcacaggcttgtaactgcccctgcccccccccaccaaagctgagagagacattccacagcaaggcttattaatggctctctcacacattcccagactccactcagccagacagaaaaagtgcagggtgatgatgcantgcnccccagtctcgngggactncggcntccatntctcagaatcntgcctgcctggattggatggggtagaaactttgttaaatntccggnangctggccnagggggtcnccttatcccanctttggaaccanag

SEQ ID NO: 23123 - DNA, 736 bp, Homo sapiens
  misc_feature 508, 522, 538, 561, 587, 604, 636, 648, 684, 694, 695, 696,699, 709, 724, 732: n = A,T,C or G
agaaagaaaaatgtatatattctatttctttggttttcctggaaggcctaacagttctacaatatttagtggaagaaattaaggaaggccaagtaccagctgcaaaggtcaacttaaatctcatggcaaggctctgtttccagcctaggaaaagcagtgatcttcctgtcccagccccacagggtcagcatcgctggcaggtggggctgtctccacctgaagcctgtctcctgtgcttgatggccataaagggatgctgcctgccaccaggcttctggaagaggtgagggaacaacctatcccaaaggatggatcttacagacccagataaattgctacaatacttgcctgcaccagttaactgtcatttctcttctcatatggaaaagggtgtcatcaagaataatccatggcaactgacaattagcaaatgctctctgcttgccttggaaatgtgttggtggtgttttcattggataaggatgtcttcacattaagaaatccttcntttccatggcaganaagcctgacttaaaanaaaaagcaagctgtccacctggnctgtccctctgggtcctacctggctnccccttctgcggggagngaactgcctcaccctgagaacaatgaaaaatntgccaggcaacncggggctctgctgaatctacctttggagcaggcggnggtacctagnnnganttaaaccccngccactgggaacccncttctaancaaa

SEQ ID NO: 23124 - DNA, 653 bp, Homo sapiens
  misc_feature 8, 41, 43, 64, 278, 419, 454, 511, 558, 560, 582, 585, 623: n = A,T,C or G
gccaagantggtccttagtgctggacttgccagttagagananttgcccatgaggccccggganccggtcccgtgtgattgatgcctgccaaacatgcccataagttttgtaacacagaagatgaggagactattgtatctgcggagacctgaaggcattgaacgacagtacaggaagaaatgtgcaaagtgtggactgccgctcttctaccaatcccagccaaagaatgctcctgttaccttcattgtggatggagcagtagtcaagtttggcccangggttttgggaaaacgaacatatatactcagaaacaagaagcctcctaagaaggtgatgatgaccaaacggaccaaagacatgggcaggttcagttctgtcacccgtgtctaccattgatgaagaggaagaagagattgangctaggggaagttgctgactcatatgcacagatgnccaaagtgattgaaaaacagctggagcgcaaaggcatgagcaaaagcgactgcaaanctggctgaattggaaccaagaagcgaaatgaagggaccttgattgcnancagttcaataccaggccttttntancctaactaaagcagctttaataagaggcaaagtatttnttatactaaacgattctttttgcctacaag

SEQ ID NO: 23125 - DNA, 720 bp, Homo sapiens
  misc_feature 110, 244, 367, 424, 430, 468, 482, 508, 600, 603, 607, 616,630, 636, 643, 662, 665, 668, 670, 678, 683, 686, 708, 716: n = A,T,C or G
catgggaaacactgtgtgacctcttacaggaggaggaaagtgcatgggacttccagtttctaggaactgtgatacaataaactcctgttgcttatctactcctctacagnattttgtcatggcagccctagcaaactactacaggggactgtgagggttaagatgacaccaaacatcaaatgccactccctgttccaacactgagaccattccacagcctctgaatgacaagacaggccttcanaatcaagaccacctggctaggtaagaagtactttagtcacaccacttctgaactttctcgcctacctgcagggcaggaatttttaccattttcaaatgaggacactgaagcccagagaagtantgctatttcctgatggataagaggtgatatatttcagtcctcagaccaactctgaantagcangcttctagtcttaagagtcaaacttggctgggcatganggttcaagcctgtnatcccagcatttggtaggccgaggcnggtggatcacctgaggtcaggagttcgagaccagcctggccgacatggtgaaaccctgtctctactaaaaatacaaaattagccggtgtggnggngggngcctgtatnccactacttgggangctgangcagganatccttgacccagaggcanaantgnangagctganattgngcnttgactccacctggggacagancagacttntctc

SEQ ID NO: 23126 - DNA, 815 bp, Homo sapiens
  misc_feature 14, 15, 36, 37, 54, 67, 74, 75, 94, 147, 154, 158, 169, 171,179, 194, 197, 209, 218, 572, 587, 608, 615, 631, 647, 654,680, 704, 710, 731, 738, 740, 743, 788, 789, 790, 802, 808,810: n = A,T,C or G
gcggccctccggcnngcgagtacgtccgaccagacnnggtaccggcctgcgagnatgacgaccagangggagannctaaggggagaccagagcnagcctaaagtcaaagactaacttgtaaggtttgtaagccccccagtgccctangtgaganaaantttctaaaganantctaatanttaagtacggttaantanttaagggctccntctgtgccnttcagggactacccctagactagggcgagccctaagggaaccccttcaagcagacaggtcctaatggcagctggaaacatgtaggctgagcagagccttccaaatgttcttggctcatgcacccttagtggtctcagtaatttttttcatgccatttctaggacaaaagaaatacttagcagtttcatttgttaagtacttagttccaaacaacttagtatttctgtattgataactttgtagttgtacaaaataatacatatatattgaaatatttaaaaataatggttttacgttactcttcatttcttaatggaatgtatgtacctgttgggcattgcatatattggtcanggtctaatgagatantaaagtacacagtaatttaanggaaagnttaaaataaacaagtnttagctaggaaacatntgacagntcctttaaatgaaaaatagattaccntatgatttagcaattttacttctngggttntactcaaaaaattgaaaggcntctcaananatntttgtaaccaaaaaaaaaaaaaaaaaaacccggggccgtttcccnnntcccacttaaancttggntnccccc

SEQ ID NO: 23127 - DNA, 759 bp, Homo sapiens
  misc_feature 3, 19, 401, 556, 565, 567, 584, 637, 642, 658, 663, 666,667, 676, 686, 687, 698, 699, 722, 724, 725, 729, 743, 749,752: n = A,T,C or G
ctncggctgcgagtaagangacagaagggggactgctgtgctagcaatcagcgagactccgtgggcgtacgaccctccgagcccaggtgtgggatgtaatctcgtggtgagccatttttttaagccggtctgaaaagcgcaatattcgggtgggagtgacctgattttccagagctggtatacgatgcctctccagaatcaccttgttctttctggatctattcagaatctgaaactcctagaaaagaaaaatgcaagatgcatgagttgagacaggatctcactatgttgccttgcatggactggaactccttggctcaagaaatcttcttgcctcagcctcccaaatagctaggactatatgcacatgctactacacctagtggaaaatgaagcacagnagaagttcagtgatggacctcagatactaccagcagaaagcagaagagctaggatttcaacttaggatgtctggatccacagtctgcactcctacccactatgctacactgcctctaactatgaggaagcaagggcatttttttttttttctggngactaaaananaaaagttcagggtatgnggctcctgaaatctaacttatacagcctggaaaattgatagtactatttccanactgnctcattcattaacagnttctnaannatcttctanttcctggcgnntttttttggtnnacttacaaacaagccaaactttnanngggncatcctcccgcggnctatantgngtaccaa

SEQ ID NO: 23128 - DNA, 686 bp, Homo sapiens
  misc_feature 593, 596, 601, 603, 609, 618, 620, 661, 669, 684: n = A,T,C or G
gggaagcacctggcgggggtcccgctcattggctgggtcctgcgtgcggccctggattcaggggccttccagagtgtatgggtttcgacagaccatgatgaaattgagaatgcggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatggggttacttgcagggtggaaaaatggctactacgaaatgcgagctgaacatagtgtggatatagatgtggatattgattggcctattgcagagcaaanagnttaanantggctnttttgcaananagctaaggaataaacttttggttgcatatgatggatgtctnccatggcncattttgtataaganac

SEQ ID NO: 23129 - DNA, 650 bp, Homo sapiens
  misc_feature 452, 500, 504, 519, 560, 562, 567, 568, 601, 605, 606, 612,633: n = A,T,C or G
aggcaccagaggaggtatgccaaatgggaaacttttcatcactttccagataaaaactagcagtctgtgaaggcaactggtctgatttttcaggaaccagacactggaacatgtcgtctgatgtacatcacaccaagaaataaaaaaagaattggaaagccaatgtccaattatttactaaaacagaatccactggagagaaatgcaaaggcaggtaaaaaggcaatctcttaacatgaaaactcacaactgtaaaatgagaacctaaactatacagcgacaaactcaggaaaaagtctccagctactgctgtctctcagactctcacagtatgtgtaaccacttcctcctctgcacggaatcaccccagaagatcaactctactagatcatttgaggacatgaacaaagtctcaagactgaattcccacagaaaacattctcatgaaaccncccaatattctggtgaagttaaagaaggcatgtgttcggagacaccanaacnacaatgctcaaaccncaaactctggattgccactctgccatcctggttcctttaancngtcannggccattcccaataacgtttcaaaactgcctcngcanntctaanaaaagcttgacttcctatggntatgtcaaaaggaaaac

SEQ ID NO: 23130 - DNA, 722 bp, Homo sapiens
  misc_feature 521, 552, 564, 578, 587, 589, 595, 606, 662, 670, 681, 686,699, 701, 704, 709, 710, 711, 713, 715, 720: n = A,T,C or G
ggggatcttgatatcttctccttttttaatggcagatatatatgacacccacctgtcgaggttgatctggggttaaagtagaaaaccctcattagatgataaagatggtatttctcccacagaaaccatttttgaaagtaaggtcggatcctccttttttccttcttacctgctcctggcctgcttggtttgttgagagtttaaaagtgagactgcttagaatcagaccagggtagagctcctaagaggacatagaaaagtcattttcctacaccgcccacttgctatctctggctgtcatatcgaaagagatttgcttataggtcattgagctttggctacagaagattttttgtatcttgacctgtctggaagagctatcattggttcctccatatgttttgtgttgcttttagcttataaaaacttccccgtgtagaattgcgtgttagagaaaaaaaggtagtaagtctcaaactgtacttggcatttgtaaatttgctatgttagtacttcacagntcgttgaaaagtcttaacaattaccaagtcnttagcacaggcnttttaaggaggaantttcaaacntnagttanagaatattacnaagagtagtagtattgggtgttctcttgaacttggctgatgactactattcattcnaattggcngaattcactgngacanttatgattagggngnttngctgnnntntncaccnaa

SEQ ID NO: 23131 - DNA, 840 bp, Homo sapiens
  misc_feature 2, 14, 17, 21, 22, 28, 34, 45, 47, 63, 67, 68, 76, 78, 88,620, 636, 681, 716, 741, 751, 766, 779, 791, 794, 803, 817,834, 835: n = A,T,C or G
antaacttgggttncgntaanncttgtnttgttncttttggccgnancggcctacggctgcgnatannacgacagnangggaccttgnaactcagcttgaactctaaactaggaggctgttagctacatgttaacacatagtaagcaaacgatttcaagcacagtatctgtgtttgagagccagctaatttaaaaatgatctatgttgacaaagaagagggaggaaagtaaacatgagcaataaattggatggcttttcctcaaatggccttatcgaaaacaaatagttttcaagctcttttccagcaaaatcttagcacttttctgcataaaagccttcagtagatcttcatcaccttcagaagagagcccaacctctctaatggagtgaactatgcttgctctgacaatcttgtcttttgtaactcatggcccagcaaaaagaaggtagctgtaattccccaagtcggccacactcttaccctcctcatctcccttgcccagactactctttttctctctttgtcttatcctccccacagtcccctaactcaccccagcccaaacacacactctcccacctcaccccagtccccaacacaaagacacgtcttaaccangctaacttttacttantaaaagttggtcaaatccatgtatgcatactccttcaggactcangtcagccgtcatctcctgaaatccttaactggttncctgttgccccggaagttttggcanatcactgggncactatgttaaagangggctattttttnttcttccctcanatntgactgccnaggacggaattganggcttctttttggaaannatctt

SEQ ID NO: 23132 - DNA, 838 bp, Homo sapiens
  misc_feature 10, 13, 17, 18, 29, 40, 49, 58, 60, 63, 71, 76, 84, 94, 99,109, 133, 733, 760, 777, 797, 799, 803, 808, 810, 811, 823,826, 829: n = A,T,C or G
ttttgacctncgntaanncttgcttgttncttttggccgnagcggcctncggctgcgnanagnacgacagnagggnagggtagnaaacttaggnaaagnatataaaagnattcatttgaatttcaaacacagnatttaccttgctttgaggaaatatgatgtgattctgtaacctgaaagagtaaaagttaggataagtgtgttatgctgaagctgaataaggggaatgagtttcatgggagagtattgattaggaatttctactagtagaaaacaggatgtccagagtcaaatatttattcttggagacattttttcccagattttctttaatgacagctctcctccattttatatccaaaagctagattggcttattcaaatgtgttaaccctaggatgtgtctgggagtcttctgagtcactactttaaggggatatctatttgaggaggcactatggtaatgaaagcaagtcaaataccaaatgtatggattgctatttaaataaccttgcacaaaccacttaacctctttgggtttccattttctcacttttataaaataagagggttgaatcggatgatctctgataacctttttatagtaagagccctatgattttatgaccctgtgaatagcatgattatagctctaggattaacatcttcaggaaatttaacagcagacttccagttaaccttcgtgattgacccatgtttttcatgttccttnctagtaagggactaaaattttgagcanagactaaaaattttaantcccaggcttaggagaggancncctnttaanannccactttggaanagnaangagactggc

SEQ ID NO: 23133 - DNA, 625 bp, Homo sapiens
  misc_feature 76, 105, 246, 265, 308, 354, 391, 407, 425, 455, 473, 475,484, 490, 494, 504, 514, 522, 530, 533, 570, 571, 575, 576,597, 599, 601, 605, 612, 621: n = A,T,C or G
ggggacttgcaggtaacaagcaaatttcagcttccggcatgatgggcgaaggcccccaccttcagcctcgctcctncatgccttcagagctgttccgccatgcantacggggagcctgcctgttctttaacctctcctacctgatgggagaggacaagctaccaggacagcttgtctcaccaagaaattgtgataccgcatcccccaacgtgctggcttcctgacttccaaagttgcggcaaggtnagaagaactacagaggaanaacctaatgcagacgtttcccaggagactttaactgaagtatnagcaaactgaaagagtttcactcttgttgcccaggctggagtgcantggctctatcttggctcaccacaagctccaactccangattcaagctgttctnctgtctcagcctcctgantagctgggattacaggcatgtgccaccacncccgactaatttttgcgntnttaatacanacaggncttnccatgttggncacgctggtntcgaactnctgacctnagngatacaaccgccctgactccaaagggctgggattatnngtgnnagccaccaagcctggcctatnananaaantctaatntttgaactncttt

SEQ ID NO: 23134 - DNA, 828 bp, Homo sapiens
  misc_feature 8, 9, 10, 13, 17, 28, 39, 41, 57, 59, 60, 67, 86, 102, 641,649, 667, 678, 736, 749, 762, 769, 777, 782, 783, 790, 795,796, 800, 803, 810, 812, 814, 820, 821: n = A,T,C or G
tttgaccnnncgnaaancttgcttgttncttttggccgnancggcctaggctgcganannagacagnaaggtgttgtctccccgtnaaaccctgcttcaggnagccacaacagggcagctggtgactgggatgtctttgaggctcactgttaccagccccagtatcttggctgcactggtgggcctcacagcctcacaccatcatggaggcactcatggtgcccgggcactcctctgtgcaaccctctgagcctcactttcacatcttcaagttacttcctcatctctttcattttccttcttactgaacttgaagaaaacacctctgctctccaagtgcatgcctcggtgcagggctgggcacctttccctccaggtctaggctgagcctgtccctcgccagcacggtcttgtttttgctccttggagccgatcctggggcggcacaggtgctcctgaaaccacctgtcggaggaggactagtgagggactgggcgtggtcatggctgacttcttggcatttgcccgcctgcctttcagtgtgtcctgtgcgcctcccttgggtggggtctccttgcccctgctcccacagggatgttctccagggtgcaggtaggagaactaaacctttcaaagtgtgntcattggnaaaattttggaaaggggnctgggcgcggnggctcatgcctataatcccacactttgggaggctgaggcagggggatacctgagttangagtgaagaacancctgccacatggnaaacccntcttactnaaaannaaaattnctggnngggnggnagggccngnanccactnntgggagg

SEQ ID NO: 23135 - DNA, 420 bp, Homo sapiens
actgtaagccattgaagaaaaattttactcaaagtttaacaagtgtttagttcatgatgaggcatttgcagctgtaagcaatcatattactgtgccatcatttagttttatggaaaatgaaaacgtttacttaaggctgttaaaagtttgttttttaatagtgcctcctaagcaatacaggctaccacttacttttgacatcgagggaaaaagagttactcagattcattcaagctttagttatattgatttctacgatgggtttttcttagcatgtcaagtgattcctgttttatagtgaaggcattactttgagtcaatatcaaagtacatgatcccctcaaccttcaactgtgtttcctgctttgtgaggtgccaacaatagcaagaagggataatttaaattccgctttccatagg

SEQ ID NO: 23136 - DNA, 714 bp, Homo sapiens
  misc_feature 2, 8, 12, 20, 26, 32, 43, 45, 46, 47, 60, 515, 547, 571,590, 603, 612, 654, 656, 672, 693, 698, 702, 704, 708, 709,712, 713, 714: n = A,T,C or G
anatcttncctncgctaaancttgtnttgttncttttggccgnannnacaggtgcacagnagcatagctttgtcccatctcaggagccctgggttccatcccagctcctgatcccaagagatacgtttcccgggactccaagggagagctgaaacactggtcaagctcagagacctgaagctctttcccactgctttagggacagcatcaaagcagggaagtaggggtggtgagtgtgtaaaatttaaggccaattgcagaggtgggggaaggatattctttctctctctctctctctttctctctctctctcacacacacacacacacacacatacacacatcctgcctcccatttttaaaacaagttgtttattaaggtcaggtgaggtgactcacgcctgtaatcccagcactttgggaggccaaggcaggcagatcacctgaggtcaagagttcgagaccagagttgccaacacggtgaaaccccgtctctactaaaagtacaaaaattangcgggcgtggtggtgggcgcctgtaatcccanctactcgggaggctgaggcacaanaatcgcttgagcctgggangcggaggttgcantgagctganatcacaccactgcactacagcctgggcaacagagcgagactncntctcaaaaaaaaaaangtggttaaaaaaaaattttangggantttnangggnnggnnn

SEQ ID NO: 23137 - DNA, 740 bp, Homo sapiens
  misc_feature 8, 18, 476, 499, 501, 570, 576, 606, 616, 621, 626, 641,659, 669, 675, 689, 693, 701, 708, 712, 726, 728, 731, 734,737: n = A,T,C or G
ctacggcngcgagtagangacagaaggggcctgtgtctttagcagcttgttctcaggcagcctcatttagggttgcttatccttcctcattcatgtgaccacctagaatgtcgttgttccccaaggtttcatcttttctgaaaatacgcaaattcgtttacttccatgtcttcatatacctttttaatgttaaaggccccaaatttatagctcaaattatctgccagagtctccagttggacattattcattctttactttctctctctctcagtctctctcttctccctttatctctagaaccaattatgtgctgggcattgcaaatgaatctaagaataagagcgacatccttcctggcctcatggagcttcctataggaaagatagactataaacaaataagctggagggttggcaggagcaatgcatgcaaggtaccgtaagccacattaaggactttggactatagcctanaggactgggaagcccctgattanangtgatcagtctatcatgtggaaaacagaccataggggacaagagcagggacatgcccaggcagaaaaanggtaanaattgatggcgccagcccaaactcaaatancacaactggncatanttttnctaaaaggttctaanctttcttaccatccccantttctaaacngacccnaaaccccgctaaanctancttttgcncctatgnccanataccttgagaggntntanccnaanggt

SEQ ID NO: 23138 - DNA, 737 bp, Homo sapiens
  misc_feature 491, 558, 642, 644, 685, 703, 706, 711, 712, 716, 717, 718,719, 723, 726, 727, 733, 734, 735: n = A,T,C or G
tctggaatagaacaagaaagatctatgtagcacaaagaaaaagttaattggaaactatgattaatggagaagtctatggggtcacgtggaaactgtttaccttgccacctctctgtagtcattaaaactcttgaaaatgaattttcttatcctaagagtgtaaaactgatgttgtggagcattttgcacatgccagacacagatgaattcaagacgcagtccctacactccgggtttctacagtttagctggacagagatgaacaaaattgcaatggagtgtgtaaggggccatagtgtgcaaggcccaacacctccctgagcgaaggacgtcagcactggttggctggatcctggccaagcttgctgtggggaagtggtcgatgtagtgtggggaaggccatttgcactgatggcccctgtggagcggaacattctcatggctgtgtctgttacccaaataactagaggatgctctgtgtgcaatcttgntttctttaatcagcataaaatctggaatgaggagaaatagcttctgaaatgcgctttctcaaagaangatgagcagaatgagcccaccatcttaccaggagtgtccagtttttggcttcctgggcccattggaaaaaaaaattggcttggncnacataaataactaccactacatactgagactaaaaaaatcncaaaaaaaaaaaaaaaanccngggcnntttnnnnaacnaannaaaacnnnaa

SEQ ID NO: 23139 - DNA, 766 bp, Homo sapiens
  misc_feature 6, 20, 36, 67, 586, 639, 647, 671, 687, 739, 746, 752, 759,762: n = A,T,C or G
attacntggtttcgtaaatntttgttgtcttcttcnttggatcgtaagctcctcaaggcctagttcntgtctcgtttacttgccttgtaccctcaacctctgtcccagtccctagcacatagtgcccatgctacaaattccagaatgaatgaaaggatgaataaaggagtgagtgtttactatgattaagggactggactagttgtatattaaaatgataaatgtaagacacatcatctgctttcaagaagcatacagtctaccttgagccaggagtgaaagaaggagaacatatattataactagaatacagggcataaatgttatgtgataaatcataggtgaaaataaagcaatatagcaagagaagacattagttatttatagcataattttaatgggaaaatatacaagttttggaaacctgatttacaaactgaattttgcaacataatgtaagtggaaaaatgctcacttatgatttaagtataacccttctataatgttcattcatttcaaaactggtatagaaatatattgttggctggggtgtgttggctcgtgcctatatcccacactttgggangccagacaggtgggtcatctgtgtcagaagttctagaccccctgcaacatggngaaccctnttctattaaaatacaaaattgtgnggggcagtgcctgtantcccacttctgggagctgagcaggagggtccttgacccagagcaaacttgcntggcaanacggcnctgtctntanccgg

SEQ ID NO: 23140 - DNA, 805 bp, Homo sapiens
  misc_feature 2, 12, 15, 23, 55, 68, 574, 674, 697, 700, 742, 758, 774,784, 795, 800: n = A,T,C or G
tncggctgcganagnacgacagnagggatgatcacaaggatatatgctgctaagnaaaacacaaaagnactgttgaagctgctgagaaggcattcaagtcagcagaaaagaaaacaaagcaaacattaaaagaagttcagactgttacctctattcaaaaagcaagaaaagtatattggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatcccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaangtagatgagtcttgtgtttggagacatcagggtgaacgaaagtcagagtacaggatgaagacatggagacactggcaagttgtcaagtgaactctatcanaagaatggacattagatggaggngcncgagcaggatgaggataagaaaacatgaactctggggagtanactctgactcaggtgncaaaggattactcttnaagggcaganatgactaatgngactntcaga

SEQ ID NO: 23141 - DNA, 794 bp, Homo sapiens
  misc_feature 4, 9, 22, 34, 45, 47, 48, 51, 80, 82, 596, 606, 614, 639,669, 700, 703, 708, 709, 733, 741, 749, 755, 764, 765, 767,768, 773, 783, 784, 790: n = A,T,C or G
atcntttgncctaacgataaancttgtcttgttncttttggccgnannggnaaggtcacagcaacttccatgtaaacagnanctgtggtttgcctggctctaagttaacaggataagaggttctcctcacagaagggggcacacagacaaacagcacccagcatgttctgttccagatgttcttcctgtcatttatggcatatgaggaggtgcctttgatgtttccctcctttcttgtcagtatgattccacgagcttcattataaattattttaccaagggatgagtcgtattgtattataatcagagcaggccctgagcacaattacaaaccaaaccagattcatccactgaagcctcttcccttttgacgttttcaatcatcatcttttccttttctattagattttgaatatccttaagtggcactcatctgatgttaaagtgtcacgccttgtgccatgcctcagcctgatgttcctcatgacagtgttctaaatcttatcccaaccaaaattcacttgtgcattgccccttcctccttgttctatcatcacaaaatctgtggtatttaattggtatgtagtttcaataanaactgatganctgactangttcaaatgttgggaaggcatctanaatatcgattatgccaaaagcaaagctaanaaagagacttccagcctacttgatactgganaanactgnntttgcactatttcaagttctgctnttcctggnctcatgcntcttanattggggtnngnntattntttcctccgnngaaaantaaa

SEQ ID NO: 23142 - DNA, 490 bp, Homo sapiens
  misc_feature 7, 21, 41, 60, 65, 74, 159, 183, 199, 235, 256, 258, 276,279, 290, 291, 295, 355, 365, 369, 371, 372, 380, 400, 411,419, 420, 425, 442, 444, 449, 455, 469, 470, 479: n = A,T,C or G
caaagtnaccattcccagggnagccttatggggaggaaaangaaaagccagttccttggntggtncattgccgncttttttctttcttggaaagggtcccggcttggcttgggcaagttaccccgcccaagcttcttctggcttcttccacaaggggcnttcccccggcccccaaccccgggncttggattaaaagccnccgcccgaactggggggcttaccaaagggccccaangccaaaggggttaaccgtttntnttttaagggaatttcccntgnttcccccccgnngggngggggccccaaaaaaaccccccccaatttttcccttaaagggggggggccaaacttttanaggggaaaancccntnntcccattntatgggggggtttaaaaccnccctttaaaanattttttnnttttnaaaaaccctttttaaananccccntttttnaaaaaaaaaaaaannaaaactttnaaacccccccc

SEQ ID NO: 23143 - DNA, 743 bp, Homo sapiens
  misc_feature 638, 685, 687, 689, 719, 728, 736: n = A,T,C or G
ggggagatactcattggagcatgagccctattgtgaactgctcatctgagggatctaggttgtgtgcttcatatgagaaactaatgcctgatgatctgtcactgtctcactttgcccccagatgagaccatctagttgcagaaaaataagctcagagtttccacggattctacattatgatgtgtattctcattttatggaagacatgttgccagagtaaagcacaatatattcatcttgaaatgtaatactgagaagatatggaagttatggaagttgtggccttcagaattgacacttacggagagactagaacagcgtgggtgagttgtgaggggcaggaagcatgtcttaatggacttaaccaattttcgtcaactattcacagtaaaatctttcaatgtacaaaatttagtaatctgataaacaataaacaaaatatttgaataggcatttttcataagacgtacaaagggcagacaggcatacgaaaaggtgctcaacatttttgatcatcagacaaatgcaaatcaaaactacaatgagatattatgtgactcagttaaatggcttatatccaaaggtaggcagtaacaaatgctggagagaagtggagaaagggagcccttgtatgctgntgacagaatgtacattttgaaaattcttcaaacactaaaataagctncntntattcaggatgccctcctgagatacttctnaaggaatcntccttganagaatct

SEQ ID NO: 23144 - DNA, 225 bp, Homo sapiens
  misc_feature 95, 101, 144, 154, 155, 163, 166, 187, 190, 191, 198, 207,208, 212, 217, 218, 220, 224: n = A,T,C or G
gggattttgagttagtctctgcattgtgccagcgcattccacagttgatgaaagaggaagcatccaaagtgagcccatcagttctacttagcatntgatgnacagtgaccccaatttgtccttgccccagcctcttctgggggnaaggctggtnnctttcttntancacctttaccaaatttatttnggnnggaactngggtggggnntttncatanntntaant

SEQ ID NO: 23145 - DNA, 537 bp, Homo sapiens
  misc_feature 395, 415, 429, 460, 464, 500, 512, 532: n = A,T,C or G
gggctatatattacataatgtgttaatgaaatgactagaaaaccttgagaacaaacaagaaacaaaggaaatttcagaatttctttctttcataatccacataaccactcctcctactctctctagtagaccttctggacatttaaatagtcaaaacgtggtcacttttggtggtgagtcatgtgggaaactgactgggagagaatatattcgggttttctggagttaaggaaatgctctacatcaaaagcggtgtgaggtcatctgctttgcaatttgtgtaaaaattttacagttaagattagcttatttcaatgtatgtaaattttccctcaaaaatcacaactgtaggccgggcgtggtggctcacgcctgtatcccagcactttggggangcccaggtgggaggatcacnaggtcaggatatcnagaccatcctggctaacatgctgaaaccccntctntctaaaatccaaaaattagctggcctggtggcgggntcctgtatcccnctactcaggaggctgaggcnaagat

SEQ ID NO: 23146 - DNA, 819 bp, Homo sapiens
  misc_feature 7, 8, 9, 10, 11, 12, 24, 44, 55, 57, 58, 59, 66, 71, 623,726, 767, 797, 817: n = A,T,C or G
gtttttnnnnnnattacttgggtnaataacccctttttttgttncttttggccgnannncgacagnagggncttaaattttctgggtcctcttttttttcaactggtagagttaggggactgagctggatgaaagacagtcagatctagttaaaaccctttcaccgcctcttgccaactcaatggacttgagcgagtcactgaacttttccaagcctggtctcttcctctgttaaataacagttccaagagtacccacctcataagattgctaagacactgaaataataccacgcttataaaatgctaggcacaattgcttgaaaatataatattataaaaactttgtgattggtttaaatgtatagagctgaaaatgttctttcatttctaaaatgtcataagtattattttttaaatggataatagggtttatagtaggattatgtatagttctactttttaaaactttccaaacttttattactgtaacttagacctataatataatcaattcataagtaacataatgtataatagtaactttttaaattaatgcaggcaattaaaaataaaatacaatcaccatccttttcagatggttaatatcttgtttgctggaangttttgctggagattatgaattctttctagtacctgtatttctgtgtccaaaaaatttacacttgtatgatttagtaatatgatgtgatagcaaaatcttatnaagctgagggtttttaattgattactattgaaacttatggncgggtgcgggggctcgtacctgtatcccanactttgggagctgagggggngg

SEQ ID NO: 23147 - DNA, 822 bp, Homo sapiens
  misc_feature 8, 10, 13, 16, 20, 21, 33, 44, 46, 57, 674, 761, 789, 794,802, 817, 821: n = A,T,C or G
atatcttngnctncgntaanncttgtcttgttncttttggccgnanagggggcaganattgcagtgagccaagaggtgccactgcattccaccctgggtgacagagcaagactgtctcaaacaaacaaacaaattaagatggctcatttgtagacattttctcatttttaaggattttcttctccctctaaactttttgtaatctttgttcccacttggattatctgctagtgagagctaatagtcaacaaaacaattgcacaaatagcaagttaatattaatggaaccatttaaacagctatctcaatggcttgtcatctgggtgcctggactcatgcttctgactttatgttataatctcatggtatagtcctattttgtctgataaagctgttttatttacatggaataattaagtaaatcaaaacatcacagcattcattaaaaacttggtggttgggatggctgtccacagaaaacactggtgaaatccaggagctgccaccacctacacactgttgaaaaacactgcagtagccctgttttgaaaagaattagaacctggactcatgtttctaccaaaggaaatatgacacatttccctttcttctttcctttttatttttgtgacagccacacctaaaccatgagcacactgatcttcaatgtgttncaccagaaatattttagccaggactgatgggctctgacaagtaaacctgcgcccttgttctagccctggcaagctctggtgccccgntttattctgctacatttttttccagttntcctntttcattnggcgaccacccaacntgtnt

SEQ ID NO: 23148 - DNA, 257 bp, Homo sapiens
  misc_feature 7, 8, 9, 10, 13, 15, 16, 17, 18, 29, 40, 42, 49, 59, 62,69, 74, 102, 203, 208, 209, 213, 215, 217, 219, 220, 221,231, 235, 239, 241, 242, 245, 247, 248, 255: n = A,T,C or G
cttgggnnnncgntnnnncttgcttgttncttttggccgnancggcctncggctgcganagncgacagnagggntttaatgaaataatcgctaaacccaagnatagtctatatttaaaaaatcccctctaatttgttgtcttgttttgttttggttcaactagaagagtgggccccacagtggggaaaaaaaaaaaagccccncttanntttntncncnnnattttttttncttnccgnannagnanncttgggnat

SEQ ID NO: 23149 - DNA, 825 bp, Homo sapiens
  misc_feature 8, 9, 10, 11, 12, 19, 22, 37, 45, 48, 49, 70, 92, 94, 115,209, 379, 557, 641, 644, 731, 744, 791, 796, 805, 818: n = A,T,C or G
gttttttnnnnnttatacngtngggcaaaaaaccccncttttttnggnncttttggaccccaacggcctnacggctgcgaaaaatagacagnanggtgaaaattatcacagcagnaaagcataaataatctaaacctacacacaacagcatgtaagtaaatctcatgcagtggtaatgttagatcataacctaaataaacttacctggnagcaggtgccactgcaagccataaaatggtaggtatgaattgctggaggctgactatggactagcttgacagtaaaaaatttggggaggtccattctgaaggaggcccctcacactttcttggattttatcttcaggaagcccaccagattttcatggtgaagatcttanaaaacatctctcatatcttggtcagttgggggaaagtagcattttgaaataatcctagagcattctccatagccaaggtttactcctcaacggaaacaactttaccagagccttatttgaccatggagaagggcagttagccccctacatccctctctagctttcttgtgttacttantggaaggaaaaaaaggataagaaacacttctgaagtccaattcagggacttgagcccactaaaagactgaaatatacttacctnctncacaccttaccaccacatcaacacagctccagaataatcacaatgggttacaatggaaagagctgcaaaacatagactctatttaanaaggaattcttanggaaattcaatgtggagaaaacaaaacactgaggaaactaaagtctntggcntcttatctntggaaacatgaanccaaccc

SEQ ID NO: 23150 - DNA, 808 bp, Homo sapiens
  misc_feature 10, 11, 14, 28, 34, 47, 48, 51, 792: n = A,T,C or G
ttcctttggnncanaaaaaccccctttnttgttncttttggccgcannggnataatgatggggtagtaaatgctaataccgtctatcttcttcccttgtatctatccctgtttttgttcccctctttccactctggcttcctattctccctttgtggcaatatccactattcttgaagacagcgaaccagcaaacctgctaatattaaagcttcagtgacccaataggtagctacactttgaggaacattttcatttccaaagaaattatctgaagagaaaaatgtctaattcaatgggctgaaatgcaaattgttatgtttcaggctagaaagatatctaacccaaggaacttccttatcatgctctgggagacagtaggctgcctcatggaaggccgttatagatgtccaactaaacattgcaaaaaatagaagcattggcttgggactgagaaatgatattcatttggtgcaaaagtaattgcgatttttgcccttgaaaatgatggtcaaaactgcaatgacttttgcatcaacctatggattagtaattgatacacaaagacatgacacatgagaataccaagtgcactgcttggcacatagtagacattcaacaaatgcttcttgctgacaacttttgctttcctcctcaatcacccactttttagaatccttgaaaaatctacaaatttttcaatattcaggaacttaaataacatcagattagagaaaaatatgctgtagccatttttggacctatcatttttaacttggatgggaatctcttnttttaaagcaaaggag

SEQ ID NO: 23151 - DNA, 714 bp, Homo sapiens
  misc_feature 3, 453, 479, 521, 537, 542, 589, 618, 622, 636, 643, 644,652, 653, 663, 669, 673, 679, 686, 687, 689, 705, 707, 711: n = A,T,C or G
ggnagggagtagttaactgcatttggcttaggtaggtcagtgaatgaaaagtgaagaccatggcaaaaccaagtttcttatttttatttatggttataacttaatgagcacggggttgaggttaacaagaggagcatgttttaaacagtttgggcacctatagggtctctttaacctctcccgttcccttaaaaagttaatgcccatttagtacttgcttattaaaatggaaggcagcgaaattgtaactgaaattgctttaattctttgatactttgatatcatggatatgactgatgcagtacggtacttgggacactcagtgcaaagcgtcgttaatgtagtaataaacagattcttaatagggttttcaggaaaataattatattcaatatgtatatctctgcattttaatcaactgtgtgtgtgtgtttgtgtgtgtgtgtgtttaanactgcccctgttttcatgaggtttanaaagaaatggaagattctggcccattttctgcattcctttanaagtgcatactgtgcntgtanagaggaaatgcatgattgttcctttggttcagaagagtaaacactanaagactgcctataggaatcttaggatatnttcntaagcgcatactantttctgnnatgagtanntgataaagantatcgngganattcanagttaanngnagatttttgtcctttngnaaanaaa

SEQ ID NO: 23152 - DNA, 725 bp, Homo sapiens
  misc_feature 9, 543, 562, 576, 581, 593, 608, 623, 624, 661, 678, 694,718, 723: n = A,T,C or G
gtagacagnaggggtggcacgatctcggctcaccgcaacctccgcctcccaggttcaagcgattctcctgcctcagcctcctgagtagctgggattacaggtgcatgccaccacacccagctaatttttgtatttttagtaaagacagggtttcaccatgttggccaggatggtctcgatctcttgacctcatgatccgccctcctcggcctcccaaagtgctcagattacaggcgtgagccactgcgcccagcccatcacccaacacttctaatctactgaaaactgtgcctcagtgagacactatatgtgaaagtgctttaaaaattatatctgtatcttattcttgtaatcaagatcatgtctgacataaacataaatattggctcttctaaataaagagttaaatatacagtatacactttactacatttacattattttggttactcagagcccccccccccacacacacacctttttttgcttatattctaatctgactttgttttagattcatgattcttaattttcaaacttagngcatatcaaaatcacccanagggctttgtctanaagtngaaatttcaganggcttctggataaanaagggattatttcannctgattggaataaatcttcagatgacctcatgtaccnctacatgaatttttaanagggggaatgggattncatgattatttggataaccatgcntcttncc

SEQ ID NO: 23153 - DNA, 810 bp, Homo sapiens
  misc_feature 2, 7, 11, 13, 21, 33, 46, 47, 623, 625, 633, 645, 647, 683,685, 688, 695, 737, 747, 753, 755, 758, 760, 768, 773, 774,779, 784, 801, 807, 808: n = A,T,C or G
antcttnggcnanaaaccccncttttcttgttncttttggccgcannggagttgtctccctaacagaataggttcctttttccattctgacatacacattctcttttgattgtcaaattattaatgttatttatctctcactgttttacttcttctgagaaaaccagaatcatgatattgtaaaaaccagagatgattctacaaaggctgtgaatgtccctcatttgcaatcttattggacccaatctttttttcattgtcattgccttgctgctgaaacaacagatgcaccctctctctaggcccagagactatgggggaaaaggtgggtgtgtgagattgtaagggccagttttgagggacagaattagttcagactctccaaatcaaggacaggcacacagattgcctaaagagctggcaaatttttgagagacttttcctcctgagccatcttgtggtccctttccatccatccaaccataaagaatttcctgctttccatagaagtaaatgagaattactaagagaatatcaagacacctggtgacaaagccttctcagtatagttgttcccagttaccggggtcacacaaataatgatataataagaaattttcatncnccttaganaaattacttaananatgcaaaaggcttgcagaacaccaaatctttaaatncntancttaaangggttagcaaaagctttgtttatatactacgggtcagtctgnactacaccanatgggnanctnangctaaacngggannctttnacccnctttggcttggtttggncttagnngt

SEQ ID NO: 23154 - DNA, 765 bp, Homo sapiens
  misc_feature 1, 9, 556, 582, 641, 682, 685, 693, 698, 718, 721, 743, 745,746, 754, 755: n = A,T,C or G
ntagacagnaagggacttgcaggtaacaagaaatttcagcttccggcatgatgggcgaaggcccccaccttcagcctcgctcctccatgccttcagagctgttccgccatgcagacggggagcctgcctgttctttaacctctcctacctgatgggagaggacaagctaccaggacagcttgtctcaccaagaaattgtgataccgcatcccccaacgtgctggcttcctgacttccaaagttgcggcaaggtaagaagaactacagaggaagaacctaatgcagacgtttcccaggagactttaactgaagtatcagcaaactgaaagagtttcactcttgttgcccaggctggagtgcaatggctcgatcttggctcaccacaagctccaactccaggattcaagcggttctcctgtctcagcctcctgagtagctgggattacaggcatgtgccaccacgcccgactaatttttgcgtttttagtacagacagggtttcaccatgttggtcaggctggtctcgaactcctgacctcaggtgatccacccgccngactccaaagtgctgggattataggngtgagccaccaacctggcctatacagaaatttctaatatttagaaatctttcaattganggttctaattttactactgggtttactaaatcaaaattggnggnggcattanatttnagggggggcacaatattttngcnctaattttggatacccttattngnngaaaaccnntcgatcagaa

SEQ ID NO: 23155 - DNA, 703 bp, Homo sapiens
  misc_feature 457, 507, 518, 538, 541, 553, 588, 597, 605, 622, 623, 630,633, 644, 647, 657, 661, 670, 683, 687, 693, 695: n = A,T,C or G
gggggtactcttgtggcaaaactgctggcaagtgtaccctttctgcagaaagtaaaaatggccttgctgaggaaattaaatttatgttcaagtgctatcctttacagcaccagggaacaagcatttctaacaatagcttatatttactacttaatgtttgatttacttttattgcaaataaggtcaaatcaaacatttacaaactggtacaataatacttttttgtaattagatatacaccaattcatactgacaatataacaaataattgtaatattcagttctagtattctactcaccacaaatccaacatttatttttccttctctattcttcctgctgaaaatgttaatctcttcagacaattatttgctatgaattcaaataactgctccaatctaataattggtcatataattcatcttaaatgatacaggtgaaataattttctcttatngctgacataagacagtctttaattacaaaacaattaccataaaaaattgnggcattatttncataactatctttctttctnctnccttcccttctnggacttcaattgcagggttgttaaactgcctgagntgctcccancattgagntctgttatttgctttannccttttnttntgggcttattntgngttttgtgcntgantaaattaangggctttttttgngacnggcctntntaattctt

SEQ ID NO: 23156 - DNA, 726 bp, Homo sapiens
  misc_feature 1, 19, 22, 30, 632, 649, 705, 715, 719, 720, 721, 722, 723,724, 725: n = A,T,C or G
ncggcctacggctacgagnagnacgacagnagggagactttcctgtaactaatatgagaccaaatccttggatagttgacaaggttagttattggcttctctgtaagtttagataccaagacactatggtgtctccttttcttggagcactccaaataagactgccactgtcatttctcaccattgggaacagtctgtaggacaaatgctgaatctctgagttcaacagtgcctcctctttgtacatttaggaatgtcagctttccattgtgagaggttacagaagttttaacaagacaaaaaaaatgaacttaaaaaagaaaaacacatgcttgggtataaactacttcttgacataagtgaaaagagcatgatataatattgtatttctactataatagtgtatgagataaaagtgagaaaaaaatacaaaaagaaaacagtaaaagtaaatatataagaagtgaccagcaactgcactaatactcatagtattatttgttctctcttttcactttgccgaacttcaaattttcttttatgaacccatattatttacataataatgaggtgaaaggaaagctctctgctttggaaatctgataattttatcttgtttatgtttttgcagntacttctttgggcagtncttcttctgatactctgacatttatggattatatgtcgaaagacgaaaatagcctngaatgaatantccnnnnnnna

SEQ ID NO: 23157 - DNA, 749 bp, Homo sapiens
  misc_feature 19, 307, 387, 401, 524, 572, 576, 580, 609, 633, 639, 659,688, 691, 703, 707, 714, 721, 723, 728, 735, 740, 744: n = A,T,C or G
ggggttatatatgttgtanacatagtgtgtgtcaattataatcttgcaatttttcatgtaaaattttggatggagaacatggttcaggactcgattacttacacaagcccttaagctgcccctaggctttgagagttcccatccagactgttgaatggatgctctggctacacggagcatggaggaatgcacatgcaacacaaggaaaatgtacagtggcaaagacgtctgaaactgcctgatttattaggaaaccctggggatgttgatactactggagaataaatacaaaaggtgtgggcagaanatcacagatcgtctctgtcatgacttggtgtagggttagtactagagatttacttctcttgctgtaaatctgtgagtggntctttctgtaaggnctttacttctttatttgtctgaagttcctctcttgggcctgttcttcatacatacttcatgacccatgcaaatttgcaaactttactttgtgcttggattcttaatatctgctcccagcctanaagtgaacctctttgtcatggggctcctgggccattcccttgcttgcnttanccancctggatatgactgcccactgacatcctntcctaagcttgcattcctggttgnccaatnagaaaaaatatgcttatggnttctttggaacccccttttttttggaacnggnttgctctgtgtnaggngggggcngggaaancnggtcntgacttnactcnggtnagctc

SEQ ID NO: 23158 - DNA, 713 bp, Homo sapiens
  misc_feature 9, 15, 56, 534, 600, 606, 615, 617, 640, 658, 664, 672, 673,678, 689, 696, 700, 701, 703, 704, 710, 711: n = A,T,C or G
gtagacagnaggggnactctcttcctaccaacttgcgagtctaaaaccaaaaaagnagtttcttgagcctcatgagaatcatggtccaaaagtgttttccagatgtttccatatgttgtacgtagtaataattacaagatgctacctacgtaccttatacattccccaaattttacatctggtatttcacttctactatttgtacttctttgtccacttgctctgtgactgacagatggggctcagcttgattccagagctggcacttgacccgaggtcttctctgcctggcacagtgatacatggtgtagcgtatccatgtatgttgtctctgtgtgcgtttctcatactttcctagtgggctgaagagctcactaacttcttgtttccacttggcatgagtatagatttgacacctgccagtctcatttttcttctgccagcctagagctcccagtttttgactttgagtctcttgataggaattgcattttttattccacattttttggtgtctctgggactagagtatangagttttttccagaaaaaactgattaaatctccctactgacattcacctgagctgtatgactctgnctcggnagacatcanantttgggggtaggatcttttgaanctgactggaaaattctanacttgnatctgcannggctnatccacctaanccttggnctannannctgccnncc

SEQ ID NO: 23159 - DNA, 409 bp, Homo sapiens
  misc_feature 10, 187, 297, 334, 363, 370, 391, 400, 402, 404: n = A,T,C or G
gggctgccanagacaaaactttgagaaggcagcttgggagtcttcccgagttccaagagtccagctcccagaactgaccatgttgggcccagcgccctctgctggtcactctgggagctgctcctccccttccccaaccaaggtaattccaaacgtgagagacccccaaaaggatcaccttggccangcgccgtggttcatgcctgtactcccagaactttgggagaccaaggcgggtggatatctgacgtcaggagctcgagaccagcctgccaacatggcgaaaccccgtctctngtaaaagacaaaatcagcttggcgtggtgggggggcncttgtattcagctcttggaggctgaggcngagaatncttaccccaggcggagttgcntgagccgantncnccctg

SEQ ID NO: 23160 - DNA, 303 bp, Homo sapiens
  misc_feature 13, 16, 18, 19, 20, 24, 31, 44, 51, 61, 72, 74, 93, 237,244, 245, 248, 252, 253, 260, 261, 262, 273, 274, 280, 289,292, 294, 295, 296: n = A,T,C or G
tttttgacctacnatncnnncttncttgttncttttggccgcancggcctncggctgcganagtacgacagnanggtaactagccctttaggnttaactagttaaggattaatagcaaaagatattaaatatgctaacatagctatggaggaattgagggcaagcacccaggactgatgaggtcttaacaaaaaccagtgtggcaaaaaaaaaaaaaaaaaaaaaaaaaaaaaattnttttaanncanccannaaaaaannnttttttttttnnaaaaantttttttgnggncnnnttttgga

SEQ ID NO: 23161 - DNA, 806 bp, Homo sapiens
  misc_feature 2, 15, 21, 32, 45, 52, 62, 64, 72, 74, 87, 103, 119, 675,700, 718, 735, 752, 771, 772, 779, 786, 796: n = A,T,C or G
tntttttgacctacnatccancttgcttgttncttttggccgcancggcctncggctgcganantagacagnancgaccttaacggnttagcaccttaacggnttagcaccttaacggnattagcgtggcaaggtatgcaagcaagtcacctgctggcaatttgggggtggggagggggaggtgcgcaatacatactggaaggagaggcacccacacaaaggacgcaggaagaacaggtgcgcacaaaggcacaatggcggcagatctgcccgtggatcactgaagattcctgctctcctgctgaggtggagattgcagtgaactaagatcacaccattgcgctagagcccgggcgacagagcaagacttggtctcaaaaaataaataaaataaaataagtacaataaaataacaaaacaaaacaaagtaagaggagatgatatctggtcgtgttttatggccatctggtaagctagattctttcctttggttttattgccaatcaatgattagaaagaagcagtttgctgttggcttgtttttcccctcaactaaatgtaagaaaaaaaaagagtcaaaaataccgaagctaattttaaaatgtatgtatagagagagacttggtcttaccttgtcatccaggctggagtgcctgtggtgccatcacggctcanggcagcttcgacctcatgggctcangcaatcctttcacatcantcgaccagatagctganatacaaatgtgggaaancacccctgctatttcttgnntttttgnaaagtcngggttcaccntgttgcgagc

SEQ ID NO: 23162 - DNA, 722 bp, Homo sapiens
  misc_feature 58, 580, 639, 650, 658, 660, 694, 699, 704, 711, 719: n = A,T,C or G
gggcaaataccacatgttctcatttacaagtggaagctaatcaatgggtacacatggnacatacaaagtggaataatagaccgtgaaaggtgggaggggagtgaaggctgaaaaactatctactgggtacagtgtttacgcttcgggtgatggggtcactaaatgcccagacttcaccactacgcagtatatgcatgtaagaaacctggacttgtaccctctaaatacacaaaaatacgtaactgactaataagaataataactgtgactgtgtggtcacttacccagtgttttttgtttgtgaaaattccctgaaaaatgtgaaacaccacactgctattaatattatgagcatatttatcatcttgctgttgttttaagaatttatttcttagggatttatgccaagaattcaaagttgattttatatattgaaattaatataacatactctaactataaataaaatgataacagccacatggccatctcaatagatacagaaaaagcatttgacaaaatccccacaaccatccatgataaaaacacccaacaaccaggaacagaggcagccctcctncactagaacagatacccatgggaaacccccagctaacatcatgcttaatgataaaagancagatgctttncccctaanancggagctagacaagggggtctggtcctacttccntcagnttatnctaaagnctaaccanacc

SEQ ID NO: 23163 - DNA, 570 bp, Homo sapiens
  misc_feature 1, 20, 23, 31, 461, 499, 522, 528, 533, 534, 540, 541, 542,548, 550, 551, 554, 556, 562, 563, 565, 569: n = A,T,C or G
ncggcctacggcctgcgagnagnacgacagnaagggagatacagggtttctccatttggtcaggctggtctccaactcccaatctcaggtgatctgcccgccttggcctcccaaagtgctgggattacaggtgtcagccactgcccccggccacttttagtttttaaattatatgcagttagtttttaaaaactacctaaaaggtagctcagactgtttgagggacgtgggggtagatcgcgtgggcagggcagagtttacagctgaaatataaaatctttaccccaaagtgttaaatgaccatgaacatttccttgtttagaaacttcagagttgtcctctctctccaaagtccacttggtgaaaaggaaataattttccatttgaatcacgccaacaccaaatggaaaatgtctttatgtgtgtgtagttacgcaagttggcacctcaccttatacctnccaacctttattaaacatcgacttcctgcacccttttnttgaaaatgattacctatgttangctttntgctnncaagannnctttancnnaangngactgnntntacnc

SEQ ID NO: 23164 - DNA, 710 bp, Homo sapiens
  misc_feature 24, 40, 67, 79, 191, 225, 227, 239, 296, 311, 313, 332, 338,348, 491, 497, 499, 529, 572, 581, 586, 601, 605, 615, 618,634, 639, 643, 647, 663, 666, 669, 691, 696, 704, 708: n = A,T,C or G
agggggaagtactgtgggccacanggagggaaggaaagcngatgtcagggctgaggaagctccccanaccatgggtcanccagcctacggaaatgggcaaaaaagccaaaaggggtcatgcctcaccttggcccacagctgagcctgtttaccggcgtcctcttcaaaatcccagcctcctggtttctcanagctgcttttggaagcatggtccatgcaaatcancngagtcccaactnatttatgagaaggggctgcagcgggtccaggctggagctgatgttttctgatatctntggtgggggctgcanangtggcagtgggaagaccangagttncgcgctgacngctgactccagcctctccacagaggctggtattaggctggaggttgtgccaaaacgcttaagacaagaacatgaaggaaggtttgcatgttggaagggaagagataagtctctggtatttgctgacaagcatctgtgtacaanacccangnaaatcagccaaagcctgcagctaatcctgngactggccaggtgacctcacaggagcgcctctggtgcctgccnactgtctcncccangctgaggaaaacaancggnaacaaagtcncanacagcgggtgccctgngacangacntgtnctgctctgtccttacnacncanggtctggcctgctccccccatncccangagtggcncagngg

SEQ ID NO: 23165 - DNA, 738 bp, Homo sapiens
  misc_feature 444, 462, 469, 483, 533, 544, 571, 619, 625, 644, 646, 669,671, 673, 693, 694, 700, 707, 713, 716, 719, 721, 731, 732,737: n = A,T,C or G
aggggtagtgttgttgttttcagcctgctgctgctgctgctgttgcggctaggggaaccgtcgtggggaaggatggtgtgcgaaaaatgtgagttaaggggccgcttctgcgggaggaggaggctgggagaacctaactgagctctcccgggaactttgctttctcgttgttttttcttcgcccacaggtctcagattctatccgctgtctttctaccctaccctttgaccatttttgcacctcccaacgaccatacagtcctatatattttgtactcagaatggtctcagttctgcacctccttgtctatttctgttgccttcccccagccccagatctcatcagctctcctcccatataaaaatgtgcagttaaaccccaacgacacctttctgtcttggcaattcttgatctttcctttctattcatgtaagaagtattgntctcctgccaaatgctanacactanaaccaaagactaangactttgccttattcattctcattagtcattatgccaggatatggcttanagtaagcccanaagatgcttgaattgaaaatcaacgtnagtgcaaattattatttccctaacttaaaacctttaataaattctcantgtgcnaaaataatttggggatctntntttgaacctggcgttcagacctncncnctaaggcccacttattttcnncttatnttatgangctttnctnttncntttgaccaannaaaant

SEQ ID NO: 23166 - DNA, 739 bp, Homo sapiens
  misc_feature 6, 567, 597, 599, 604, 607, 620, 630, 640, 642, 671, 672,691, 696, 701, 706, 710, 723, 727, 731: n = A,T,C or G
gacagnagggggcagtttgatctccgactgctgtgctagcaatcagggagactccgtgggcgtaggaccctccgagccagacttgaactgaagcatcagctcttccttgtcttgggcctactggccttcagactggaaatacatcatcagctctcctgggtatcctgcagatcttgagacttgtcatactccataattaggccttgcccagggaagatgggactggctgatttgaaagactggtgcagctctggactgagaggacttcaagctaagtgatgggtcctgaggtctagggactctttcataaaccatctcatttatggaaacctgacacacatatgggaaactagatctttcacttgccttttactcttctctcttgcctctgtctggccccacatatcaatgtgtacttgtagtaaaccatcatggaagctactggcaacacaggtcaacaattttgaccccaatgggtgaagctaggtaccatccagccctcaaagctgtaggcctttctccatactcaaacatattttgtgtcctattttctgagctctcccctangatgaatttgatccttgaatgtgtgctgangncccantgngtttctgtgtggntcatgcccancaagggtttncncttataaataaaaaattggctgggccagnngctccacctgtatcccacnctttnggagncaagncggngatcctttaggtngganttcnaaacaccc

SEQ ID NO: 23167 - DNA, 741 bp, Homo sapiens
  misc_feature 59, 447, 454, 506, 599, 604, 613, 622, 641, 673, 675, 701,703, 707, 721: n = A,T,C or G
gggtggacatttgcttacatggggaacaccacacaagtaccgtatgagccagtaagaanatctggctagaaactttaaacaaattgctaaaggctgaacatgggctcgcaggagagggtggcagacccggggaggtttgtactttgttgtaggcgtctcctctgccaggtgccccaagggaagacctgggagaatctcgagaagcctttcctgtggtcttgaccgaggaagttgaacagcagccactgcagaacctctagctgaacccatgtccttcatctttcctactgactagaacattaatcttcaggaaggatacagaactgcagcctgagggcactggtggatccctctagaggaggggaagaagaatggcaaccactagcaatattcaactcagaatcatattccctgtcattcctaagaaacaaatgccctaatctacangaggaanggcaaccaagatgtatcctgaggttcctggtggaaactcactgtacccaganggggagaaaagaagaacacaaaaaactctacccatggggaaagggcaggaatgtgcgctacctaacattaccgtatatctggagaaagctcangaacncttgtgaangacacaccnccaagactcttgttcagantgcctacctgaggctgaggctttcggaacatnanataccattttttttcttccttttcancncccnctaacaactttganaaaaaaacagggaatacact

SEQ ID NO: 23168 - DNA, 772 bp, Homo sapiens
  misc_feature 605, 678, 690, 698, 716, 720, 726, 729, 757, 761: n = A,T,C or G
aggggagttgtaacttgcctggtgcccaatagatgtcactctgttttcctagaaactttaaaatatccctcagtgctcctgttaattcatggtagtgccccaaggcactctggcacccagttttggaactgcagttttaaaagtcataaattgaatgaaaatgatagcaaaggtggaggtttttaaagagctatttataggtccctggacagcatcttttttcaattaggcagcaacctttttgccctatgtcgtaacctgtgtctgcaacttcctctaattgggaaatagttaagcagattcatagagctgaatgataaaattgtactacgagatgcactgggactcaacgtgaccttatcaagtgagatggagtcttgccctgtctccaaggctggagcccaatggtgtgatcttggctcactgcaacctccacctcccaggttcaaacgtttctcctgcctcagcctcccaagtaactgggattacaggtacccaccaccatgcccagctaattttttgtatttttagtagagatgggggttcaccatggtggccaggcttagtctcaaactcctggcctcatgtctgcctgccttggcctnccaaagtgctgaaatacaggtgtgagccactgtgcccggccacatttctaacctaatagtttagttttatagnttattacccagngaacctcnccaaaatttatttgaatnttantaaaanaanatttgtttaactttaactgattttatanctcncatctttaagt

SEQ ID NO: 23169 - DNA, 606 bp, Homo sapiens
  misc_feature 6, 464, 520, 524, 526, 531, 548, 552, 560, 573, 576, 587,598, 599, 601, 603, 605: n = A,T,C or G
gacagnaagggttgctttttctaaatcacagctctgatcaaatccctcctaagcagaagccttccaggctcccctccataaggctccaggtgtttacttaccttgcctgtcaggggcttctgcagcttgcttcctacctgctatctccactcctctccaaaccaccatatcctgaggcttctagaaagcaaactctggcggcatggggttaatgggtctgtgtacccaagacactgtacctgggtgctgtcatctgcctgactgaccttcctgtgtcctggtccgatggtgtctttgatcctatagctaagatcaagacactgaaaatctctagactcaagtctgtgcttttgctgggataaagtttgtgttgagtacatctaggctgggtgtggtagctcacgcctgtaatctcagcactttgggaggccaaggcaggtggatcatctgaggtcaggagttcnagaccagcctggacaacatggtgaaaccctgtctctgctaaaaatacaaaaattanccangngtggnggcaggcgcctgtaatnccanctactcangaggctgaggcanganaatcccttgancctgggaggcnnangntnc

SEQ ID NO: 23170 - DNA, 740 bp, Homo sapiens
  misc_feature 1, 9, 532, 631, 665, 673, 679, 682, 685, 694, 701, 705, 706,707, 710, 712, 715, 717, 722, 724: n = A,T,C or G
nacgacagnagggggtatgtttattggagaacatgcagtacaggttgtggcttacactgaaacaaagctaacatttaacttacacatttttattttattatatagaattgtaataaaagacattggatataatacatgagaaaatttaatgaatactataagacgacttacagacatcttttagattattatagtttggttagacattgtcataaaaacagaagagaaactggtttaaccttactttattcagacttcactgtggtgtcagccaactttatccctcaaatattttaacagtaatgtacaaaatggagctatagatctctaatgctagaagagatgtccaagccttcactttgtagacaaatcccaaggcccctgaagattatgtgatttcccagaagttctattacgagttaattccagaacaagtcaagaattaggtttcttgactctaaatagagtatattttctaccatgttacattgactcatataaggtgattgttttcatgaatagaatatgttgnaattttttaattatatgtgttaataattaagtaaaaggatctggtacagatgtgagctcaaaaaataaataaattacttccttggttgaactgcaatanttaaatggcttgtcatttctgggcaacgtgcgtnctatgaanaattgncanaanttttttttnttgaatngatnnnggnanctngnctttnancccttccttggaagct

SEQ ID NO: 23171 - DNA, 633 bp, Homo sapiens
  misc_feature 382, 432, 441, 444, 510, 527, 537, 563, 566, 572, 575, 576,577, 579, 585, 591, 592, 593, 604, 619, 631, 632: n = A,T,C or G
gggcaagataaactacaactgtgaattgtgctatagggaggtaatatgtggtccaaattccaaagaatttgagaaagtgatagaaagaaaacgattggtgtttcaggtacttatatatggaagtttaatgttgtaaataagaaaacgggtgtgtgtaggagggataataacctcttatccacccacagacttccttaagcaacaaatactgcaggaagaaaaagtattaaaggtgcctcctctcaaaattcagaggtgtgtgggtggttaaagaataatttttaacccctgcttttctctataagtctttcagtcatattataaagacaatgctatgaatatctccattactgttttttttaaatatttatgtattgcttanatctttgttagattctgaaaaataaataagtctggtgaaattaaaccatnttttaactntcnaataattattaatgtattatcctgctgtacatgagcagaatcacagttaaattttatatcatcttntgggaagttgtttgatnatgtttatanaataaaatgtttcttagatccccgcntanatccantannntntttttntttctnnnataaaggaacnccggaccttcttttncatttttttttnnt

SEQ ID NO: 23172 - DNA, 345 bp, Homo sapiens
  misc_feature 1, 9, 218, 231, 239, 241, 250, 253, 280, 289, 312, 315, 324,328, 331, 332, 334, 336, 337, 341: n = A,T,C or G
nacgacagnagggtacttactaaaaaaattactcccctttctccatagaatgcacgcaatttgacctcatgctacacttccagtctctactcctgcctctttatgctctgtccacatgtgatttctcactattctctacatggcttgtgcccctataaggtttgtgcccttcatttcctgcgccctctacctctggttcccatgctcagaatatcagngtccttactgcanggggtgtntnagctcaaanctnaccttcttcccgaagcccctatagacncccagaganggattaataatggacccttcctnccntgtttcccnaaanacnngntnngggntttt

SEQ ID NO: 23173 - DNA, 679 bp, Homo sapiens
  misc_feature 405, 536, 560, 578, 602, 604, 608, 613, 616, 624, 629, 632,653, 654, 655, 672, 674, 676, 678: n = A,T,C or G
aggagtgcaagaaagaaaatcagcctggccagtggtgtgagctgagtgtctgcatccagacggccagttgcttggtctaggatggggggcaggaggttagtgtggagggagccccagcgtgagaaattgagggagcaactttgtctctgaaactcaagagggtggaggcaagacttctatttttgttgacaggtgccccaagtttcagccctgaaccctgacatatcttccttctcccaagtcctttttcttatttttcttgttttgtattgttttgttttggtttggtttcttttgagatggagtctcactctgtcacccaggctggagtgcagtggcaccgtctcagctcactgcaacctccaccttccaggctcaagcgattctcctgcctcagcctcccangtagctgggtttacaggcacacgccaccacacccagctaatttttgtattttagtagagacagggttttgccatgttggccaggctggtctcgaactactgacctcaggcgatcccccgcctcggcctccnaagtgctgggattacaggcatganccactgtgcctggcttgntttgtttatttatttattaaacanantctnctctntcncccagctngagtncanggtgggatcttggcttactgnnncttcccttctgggtcancnantnt

SEQ ID NO: 23174 - DNA, 714 bp, Homo sapiens
  misc_feature 656, 666, 682, 706: n = A,T,C or G
cttttcctgccctggatctccgccgccacctcggtctcgctgctcctgggcggggggtgaggacgagtccggagtatctggggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgagatttgccgtgttgaccggtttggttgaagttggagaagtatccaatagggatattgtagaaactgtctttaacctgttggtaggaggacagtttgatctggaaatgaatttcattatccaagaaggtgagagtattaactgcatggtggacctactggaaaaatgtgacattacgtgccaagcagaagtctggagcatgttacagccattctgaanaaagcatacngaatcttaagtctgcnctgaagtaggccttgttgaaaagncttgaaaa

SEQ ID NO: 23175 - DNA, 742 bp, Homo sapiens
  misc_feature 9, 120, 313, 526, 531, 539, 543, 573, 591, 592, 596, 598,601, 619, 633, 639, 640, 645, 654, 660, 663, 678, 681, 700,704, 719, 730, 731: n = A,T,C or G
gacgacagnaaggggcactgtcaaaaagagattttccatgatgatgatgccatccctggatgggaagggaaaattgtagcttgggtggaagaagaccatggagagaattaatgccaagtntcagattgagggcttatggaacctggtcactccctggctgcttcactcaggaaagggaactaaaaccagaatacactaaggaagtttctagtttgtgtgccaaaacaggaagcttctccaagcatgatggccacaggtcagtcctctttctgtgcctggcatatctggtacttaaaattctgtccaaatgtanaccatgggttcatctggagttccttgtccgtgggaacacagtgttctattctactctgaggacaacaaaccgaaggccttaaacgatggggatggatgatcccgcctctgtaggggcatggctgctattatctggaaattaggaattggatgcatcattcctgtgtgttacagtattattttaattggcctcaatgggtgcaccaatcagagncccancgtttgtnctcncagacaaggcaaaggtaccagcttttctgnttctttgaacctcctgcnnaccnanaanactcttgaggtggtcccnaggatgaaagcccngacttnngaatnttttgaccngacctnganggtgcttaattgttnctnggttggaaaaggctgcccntttntgcttccctttgctnaactggatttnnaaaacttggct

SEQ ID NO: 23176 - DNA, 751 bp, Homo sapiens
  misc_feature 9, 11, 345, 346, 564, 655, 665, 674, 690, 728: n = A,T,C or G
gacgacagnangggaattagacggggaggaaagtctttgaagaggaacctctgctttactctgtacagctcggagctgcttgcagcactctgacgccttctgtcgggatctttggaagacctgcctggttctcccgtctgtggaaggatccaggtacttcttacaacatctgtgttagggcagctggtgatggcacccggcaaattccagcaactgccttcattccacagaggctccctcctgcaaggccactactgtgactctgagcagcggttcttctcatgaatgtgatagctcggtcagctctaagactgcaacctgcaggggcttcatggggcaaccctnnggtatgtggccagtgtctgtccttgggcagccgtagcccctgtcaggaacagggagtgactcaggcacttggtgtcttgagactgctgcggtgtcaggaaacttccataaaatctagtgagttttaaaaaaagaggccagcgccggccaggcacggtggcttattgcctgtaatcccagcattttgggagaccgaggcaggtggatacctgaggtcangggttcgaagccagcctggccaacatcgcgaaaccccgtctctgccaaaatacaaaattagccagcatggtggcacatgcctgtagtctanctcttgggangctaagcangagaatacttgacctngagggggaggttgcatgaccggaacgtccctgcttcanctggcacaaaggaactctgtctc

SEQ ID NO: 23177 - DNA, 609 bp, Homo sapiens
  misc_feature 328, 380, 460, 467, 533, 538, 549, 553, 558, 585, 588, 593,597, 599, 602, 603: n = A,T,C or G
ggggacggagggtgaggtcggtacgcggtggtggcgtcacggcgccagctcctcccgacgccgagattgggtaactcaaggcgtccctggagtacactgaggataagtgtttgagaaatgctgtctgaaggaatgaagtcagtccatgacaacgtctctctgccgtgcatcattcctgcagatgaaaaagtgtgacttggcagctgatggagtctcgctctgtcacccaggctggagtgcagtggcgcaatctcggctcactgcaagctccgcctcccaggttcatgctattctcctgcctcagcctcctgagtagctgggactacangcgcccgccaccacacccggctaattttttgtatttttagtagagatggggnttcaccatgttggccaggatggtcttgatctcctgaccttatgatccgccctccttggctcccaaagtgttggattgcangcgtgancactgcgccagcctccagcctcagtttcttatgtgtaatggggatgataaacccgactgcttgacnggtanttgatcaagtnaatnggccnaaaaagctgattgaaaatgtcaaactnttnaaggntttnanaanncttcaa

SEQ ID NO: 23178 - DNA, 840 bp, Homo sapiens
  misc_feature 2, 16, 17, 29, 40, 42, 49, 60, 63, 71, 625, 691, 692, 719,739, 740, 746, 755, 816, 817, 818, 819, 826, 828, 830, 832,833, 837: n = A,T,C or G
tncttgcctacgatannccttgcttgttncttttggccgnancggcctncggctgcgagnagnacgacagnagggtgttgaacattatactgtggcaattcattatttcttgtaatatttatttttaggaaaatttccattcctcatcttcaaacaataatttatacattaatctcaggtctgaaatgtggaagaaagaaatcagaaatagttaaacgacattctgtccatcctattagtaacatcccgtttttccacattaaaggaagctgacatctggaaagggtatctagatagtttaagtgagatgtcctaataacttgttctctgtagaagccattgcaatttacaaagccttttcatatatactgtctccttcagtcttcacaacaaacatgtgaaagagatactatatgcttttgacaggtgagatattgaggttcagggagattaaataaaaagagaatgtgatagaactaaggttaaaaccatcattgctaattccagaatccagcaagtgtgaggaccagggaagaaagtgtcactatctaacaagtcccagctttgggactgactctgcaccttaagcgttaaccatttggcagttccagacccaaaatatttntcatgtggtacgttttgggagatgctcaaagagtactcaatctattattctaagcatcctatagtnnataatggttgctttaaatttttccttntttggttctatttttccctnnagaaanaacagaggnaagggttgctactgatatcctgcttataaaaaaaaaaaaaaaaaccccgggccctttttcnnnnccaatanancntnnagtnccc

SEQ ID NO: 23179 - DNA, 762 bp, Homo sapiens
  misc_feature 15, 447, 596, 640, 646, 650, 737, 742, 747, 760: n = A,T,C or G
ggggatagcactagnatactcatttttagcatgaaccctattgtgaactgctcatctgagggatctaggttgtgtgcttcatatgagaaactaatgccgtgatgatctgtcactgtctcactttggccccagatgagaccatctagttgcagaaaaataagctcagagtttccacggattctacattatgatgtgtattctcattttatggaagacatgtcggccagagtaaagcacaatatattcatcttgaaatgtaatactgagaagatatggaagttatggaagttgtggccttcagaattggcacttacggagagactagaacacgggtgggtgagttgtgaggggcaggaagcatgtcttaatggacttaagcaattttcgtcaacgattcacagtaaaatctttcaatgtacaaaatttagtaatctgataaacaataancaaaatatttgaataggcatttttcataagacgtacaaagggcagacaggcatacgaaaaggtgctcaacatttttgaggatcagacaaatgcaaatcaaaactacaatgagatattatgtgactcagttaaatggcttatatccaaangtaggcagtaacaaatgctggagagaagtggagaaaggagcccntggctnctgntgcaggatgtacatttgaaaatcttcaaacactaaaataagctcctatattcagaagccctctgagatcctactaaaaggatcctcnttganaattntcctcctgttgtnca

SEQ ID NO: 23180 - DNA, 703 bp, Homo sapiens
  misc_feature 10, 17, 38, 93, 109, 361, 527, 528, 530, 583, 612, 622, 662: n = A,T,C or G
agacgacagnaggggtntaaattctggttgtcctactntttgtggtattcactttaattactcaattaaggtgatagcaaccagatatccccnttttaaaatatatttntttaaatagatataaatataggtttaaaatatatatatttatacagatatctgtatcaatatgtgtatatttcaaaagttgaaatatttgaaattataaattatatttgaaattataattcatatggtggtatttagactttatgtgaaaactgcatttcccaacattttactttttgagtctagcatccactgataatcttttgctcaattaattatctttattggagatggagagatattcattttacanttattagccaaagtttttctttaatgaagggcacttccctgagtgacaataggtgaataacaattttcacctaaaaatacagcataagtatttaatttgctactctattaccaatttttagagtaaggagtccatgtaagagtcactttcaatgtttgaatttaanngngtgttccctgctttcttatatctctaaaacccatggatatgtatctattcagngtgttacaatccattgtaatcttattctnttcatggtcnatgctgccaatttggagaatggattactaagtggctcctnctctggtgcatccttgggtagctttaaatttatggccttcc

SEQ ID NO: 23181 - DNA, 792 bp, Homo sapiens
  misc_feature 6, 107, 133, 364, 482, 585, 611, 631, 645, 662, 672, 680,682, 694, 699, 701, 715, 716, 718, 736, 739, 748, 758, 763,777, 786: n = A,T,C or G
gacagnagggataacttgttacgccttttatcacataaaatacgaacaattttttgtcatcgaaaagtcatcacaaagatttggtggcaaaaaaagttgaacttcancaagatgtttatttaaagtttaaagntttcatttcccaattgagattttatatttaatatactctaaaatatgtctgttgtaatcctagaaactgattatactgcaccagatgtaaagatgctattttcaatttctaggactcggaaatacataccatatgactgcagttttgtaaaacatatcaaaattgcataaaacataatgaatgaccaattttgagtatctctatgctaaatatgcttaactgcttaatgtngtgattgttgaattcggtatcatttaattttatgatctattttacccatattaccatattgatgtactttacccaggactctcatactttctcccttttcttaaaggatattcagtcngagctggtcattttcggagccagcatactacccgaagtagtcggaggagctcctcaacatgagcagattggtaaggcatatatattcagcattgatgaaaaanaactaaatatctacatgaaatgaaangtaaaagctggatcgacttnggagctctggctgngctgggacctcatgcanatggcttctnaatctgtngnggagcccctgcngagcncntagaaagaggaaanngntggggcatcactctggtnggntggccaagncccactgganccttntggatatgacaacnaatgggctntccaaa

SEQ ID NO: 23182 - DNA, 762 bp, Homo sapiens
  misc_feature 16, 27, 619, 646, 656, 665, 668, 698, 708, 719, 725, 740,757: n = A,T,C or G
tggtgtgttccaaagnaagttcagggnatggaaagaatttcagtcatatatttaagagagacttctggtttattttgagcagtgacagatgtcttcaaaactaacatccaaacaaaggcatttcctctcaaattggttggcatgtctgttgacattttgggctgaggaattctttgttgtaaggcactggtttgtgtattataagataatttgcaacatccctggtctcaactcactagatgccagtagcaactctctccagttgtgacaacaaaaatgtctccagacattgttaaatgttttctggggatcaaaatcaccccaggttagagaccattgatttaggcaaagtgctggttgtgactattttaaaaaagggcccatgttgcccaaaagtttcttggtattctttttctatgctacctgctaacttataaaacatcttgctgtcttgcttgaataaattacaaaatttttattatcagaattttttggaggaagccacaagaaaggaaaagtctaagtctaccaaataattctttaagtttcactttttcatttgtcaaaacacacacattcttacacacacacacacacacacacacaccccatctatggnaataccacagaaatgttgcctttttcncacaaagaantaccaatcnccncccagatccagctcaaaacttttgagttancaacactgcntgttctcctcntagcgnagttgacatgaaacnctggccagggggggacntcccc

SEQ ID NO: 23183 - DNA, 369 bp, Homo sapiens
  misc_feature 4, 7, 10, 12, 13, 24, 32, 36, 56, 58, 59, 60, 63, 64, 66,68, 73, 76, 163, 201, 208, 217, 221, 265, 266, 270, 271,278, 281, 310, 328, 352, 354, 355, 364, 366, 368: n = A,T,C or G
cgtncgntananncttgcttgttncttttggnccgnagacggccctacggctgcgnannnaannangnacagnaangggaatcattttccttatctgcttcctatcctgtatgcccttttcctaacactcacaacaaaactaactaatactaacatctcagangctcaggaaatagaaaccgtctgaactatcctgcccgncattatnctagtcctnattnggcccttcccattccttacgcattcctttttaaaattaaaaaannaaannaggggcnaancgaaatccccccttcccccttttaaaaanatgtaaaaaaaaaaaaanatttggggggccccccccccccanannggggggggntntng

SEQ ID NO: 23184 - DNA, 654 bp, Homo sapiens
  misc_feature 455, 514, 535, 547, 549, 622, 631, 633, 653: n = A,T,C or G
gaaagtgaatatttggatgggtacggtggctcacgactgtgatcccagcactttgggaggctgaagcaagaggattgcttgagctcaggagtttgaaactagcctgggcaacatagtgagaccctctctctatttattttaaaaagaaaaataattttaaaaaatcaaaatgaatatttagcatgagaaaaaattacaataaattatacatttaagaaagtggctgcattcaataaatattatagaatccagggaaaaagcatagtctttttattaactgcctgatccacctctataagacttcttgtatattttttgactgtctaatctttagctgcctcttcatatgtaatattttcttgtagagaagagaaaggcaatgcgatacatcttatgttactgctcaattgttttttgtttgtttttaagaccgggtcttgctctgttgcttcaanggtttgaatctctgaattcttattaccacctggtctgtcactggtacttttagttttancctctctagtagtcatgcagngcattgcatggngnctgaacggccttcctaatgagtgcgctgctgggccctttctggttctggccctccgtttccctggtagctgcngggaggggnantttttcttttcccaaaacanc

SEQ ID NO: 23185 - DNA, 563 bp, Homo sapiens
  misc_feature 410, 445, 501, 510, 512, 523, 525, 527, 529, 530, 531, 532,537, 538, 539, 546, 549, 553, 558: n = A,T,C or G
ttcacattaaattacacgtcagtatgtggcattaggggaatggtagaaattctcagtgctaagaattgagtggcccctttaaccagctaccttgacccccaaagccaagatttgtaatggaaaaatattgtatgggcagggtgcctgtggcttacgccacagcactttggaaggctgaggctggcggatcactcgaggtcaggagtttgagaccagcctggccgacatggcgaaaccccatctctgctaaaaatacaaaagttagccgggatggtgacacacacttgtagccccagctactcgggagactgaggcaggagaatcgcttgaatccaggaggcaaaggttgcagtgagccgagatcacaccactgtactccagcctgggtgacagagcaagactctgtctanaaaaaaagaaaaagaaaaattcatatgactaatantctgcctcatatacctatcttttcccagtttaaaacatctttctttatatacccgntttctcagntntaaagtttctnantncnnnntggcnnnatttcanagngaanccctngcttt

SEQ ID NO: 23186 - DNA, 582 bp, Homo sapiens
  misc_feature 6, 66: n = A,T,C or G
gacagnaggggcccccatcttccctctcctcccagcttgcaggcttagttgagtgtctcacagggnacaaaagggcctacctacttcctaccactggcctcccttgcaggccacctctctttctttcttggaagacccaaagagagtcttttgggaaatacatgtgaaagtgtattcctgagtcctagccagttgtaccaccttaccttcaattcataccttttttccccctaaatttgaagtttaaaatctatgttggaaagcagggatgggggaaattccaatgaattaaagaaaggtcacggccgtgcgcagtggctcacgcccgtaatcccagcactatgggaggccgaggtggctggatcacctgaggtcaggagtttgagaccagcctgaccaacatggcgaaacccagtctctactaaaaatacaaaaattagctgcgcatggtgggcacctgcaatcccaactactcgggaggctgcggcaggagaatcacttgagcctgggaggtggaggttgcagtgagccgatatcgcatcattgcactccagcctgggcgacagagcaagacactgtctc

SEQ ID NO: 23187 - DNA, 747 bp, Homo sapiens
  misc_feature 8, 21, 576, 657, 663, 674, 680, 693, 713, 715: n = A,T,C or G
ggggaagnacatgttgccagnagtaaagcacaatatattcatcttgaaatgtaatactgagaagatatggaagttatggaagttgtggccttcagaattgacacttacggagagactagaacagcgtgggtgagttgtgaggggcaggaagcatgtcttaatggacttaaccaattttcgtcaactattcacagtaaaatctttcaatgtacaaaatttagtaatctgataaacaataaacaaaatatttgaataggcatttttcataagacgtacaaagggcagacaggcatacgaaaaggtgctcaacatttttgatcatcagacaaatgcaaatcaaaactacaatgagatattatgtgactcagttaaatggcttatatccaaaaggtaggcagtaacaaatgctggagagaagtggagaaagggagcccttgtatgctgttgacaggaatgtaacattttgaaaattcttcaaaacaactaaaaataaagctaccatataattcaggaatgccactcctgaggattcacttactagaaaggaaatccatcattgaagagatatctaccctnccatgtttgtacagcagtgtgctccagccaatatttggaagtacctgatgtcatcaagaatgactggataagaaactggcnctatcncatggatactnttagcntaaaatagatctntattgcacacattgtggacntnattaggaatagcagccaaaacactttctgtct

SEQ ID NO: 23188 - DNA, 772 bp, Homo sapiens
  misc_feature 1, 9, 528, 680, 683, 687, 707, 711, 722, 734, 750, 753, 756,758: n = A,T,C or G
nacgacagnagggctaacaggggccatctcattaagctacacagttatttataaatgaaagtataatctagcaacttacatgtcaaagtcttccactagaaagatggcaatatttgactaaaactgcaaagtttgtcccagttgacaaaactctaatcaagcccctgcccttctcattctgtttttccttttaaactttttcttatattttaatttttcatttgacaaatgcatatttcctctttataccatgcttccaagtgtcactctgatacataccttcaatgagcagacacaggattgtggagtttgttgtggacactcatcccatgaatagggagactccgataacctgaacagatggctctagaaaagaaaggaaactttcttttccttccatacagagcttccccccattatttcagtgtacacaaaccaacatcagttctttaacacaaaaataaaaatactcaagatcaagcaattgtgaggggaatcatctttccagaagtcaattcttctagcggntaccttcagcatatacaacttgaataaaaagaagttggtcaaacgagtaaaactttccacctcattccagttctatctacccattgacaacaccttcggtcttctcacaatattgagtagaacactgccactcttaccttttctggctcttnccnagcnggagaagagtgactattggngganggaatctatcnttggccctcaancctgggcccgttgccntantangnaacttctcaggtca

SEQ ID NO: 23189 - DNA, 668 bp, Homo sapiens
  misc_feature 259, 266, 297, 302, 305, 317, 325, 359, 375, 385, 401, 408,409, 416, 420, 432, 440, 449, 451, 452, 478, 502, 509, 523,526, 553, 591, 601, 613, 616, 618, 630, 641, 650, 651, 665: n = A,T,C or G
ggggcaatctttgtattgtttttctactaagtaaaaaggtcagacttggatatggtacatttaaagaggatgctgattagtcacaaaattttagccatctaagagttcattcagtttctccctagggtgtttcccttttattaatttcctttgctttctggccccagaagtgtaactggtaaccaattttaggtgtggtttctaatataagtttactcatggagacaatgaaaaaaaaaaaaaaaaccccaaaaaaaanatattanatctgctctaaaaaatccaaggttttttttnaatgnggncatggctttttnaaaaaacnttttattttcaaaattcctgggagttgagggttnaccccccctcctttanccttttatcncccccttaaaaaaagnacctggnnccctttnaaanccgcaaaaaccntttttttntttggggcnannggggggggaaccggaaaaaaaaaaanccccccccttccttttaaaggaanccccttngccccaaaaaattnttngggggggggggggggcctttacccccnccccccctttaaggaaaaaccaattttttttccccccnaaaattttangggggaaaaatnttntntttttttttaanaaagggggggnccccaaatnnaaaagggggggggnggg

SEQ ID NO: 23190 - DNA, 818 bp, Homo sapiens
  misc_feature 3, 4, 5, 6, 11, 17, 28, 30, 37, 46, 48, 51, 58, 75, 76, 77,490, 581, 646, 755, 763, 778, 789, 812: n = A,T,C or G
atnnnncttgnttgttncttttggccgnancggcctncggctgcgngnagncgacagnagggggtgaatcgcagnnngcaaaaggcaaactgaagacacaatctcatgacaatagagacataatagacatctattcatcgaataagttaaagaggagctctttctgagatgaagagaatcctcaatgtcaagatttgaacaagaagagaatggaatacacaatatggacatccataaaaattcatcagagagcattttactactgagctgcaaaggtaggaaaaataaattttttttggttagaaaatatacttctttcatctgcgtttcaataatttattccccttgttagatatacatggaattgatattgcttattctgactaagtgaaaagtgttatttctacttactgctcaattagaaacatgtagtgtttaatgtcagtttgaatttttctttcatactattacagtttatattttactatangcagaatttcctctttatcctaaattttgatattctccataatttcatcgtgccttgacattgctgtatataatttctatacatcaggaangcaattctgtgtgcatgtgtgtgtgtatatatatagttagaagttagaactgaactcttttttgncaccatcatttcatatttttcttgctatttcaacctatatttttaagaacgactaacgtaatcttcatagatatgctgcagtaccttacatttaatggtacatggagcnttagtcanattgcttactaatanaggcaaaaatnggcctttccgtagggggtggganaaatta

SEQ ID NO: 23191 - DNA, 836 bp, Homo sapiens
  misc_feature 2, 9, 10, 15, 17, 18, 20, 27, 33, 45, 47, 48, 56, 68, 93,649, 707, 739, 755, 762, 765, 771, 782, 793: n = A,T,C or G
antaactgnnctacnanncnccttgtnttgttncttttggaccgnanngggccctnatcattccaggnaggcgaaagctatgcactgcgcagnaggctgggaaggctttaattaaattcaaccactgtgagaaatacatctacagcttcagtgtgccccagtgctgccctctctgccagcaggacctgggctcgaggaagctggaggacgcacctgttagcatcgctaatccatttactaatggacatcaagaaaaatgttcattcctcctcagaccaactcaggggacatttcttagagagtatgatggaaggtctgatcttcatgttggaataactaacacaaatggggttgtgtataattacagtgcacatggtgtccagcgagacggagaagggtgggaagagagcataagcatcccattactgcagcccaacatgtatggaatgatggagcaatgggacaagtacctggaagacttctccacctcgggggcctggctgcctcacaggtatgaagacaaccaccataactgctactcttacgcactcacgttcattaactgcgttctgatggcagaaggtagacagcaactggacaagggtgaatttacggagaagtacgtggtcccgcggacaaggctggcatncaagttcatcacactctaccgggcgatacgggagcatggcttctacgtcactgactgnccccagcagcaggcacaaccccctgaggcggnggttgtgctgagactntgtaacncancctggncctggaggtanggggggtgctnctttatcagactatgattctaatgcatttactggggtataaaa

SEQ ID NO: 23192 - DNA, 745 bp, Homo sapiens
  misc_feature 524, 525, 584, 588, 650, 652, 663, 665, 680, 683: n = A,T,C or G
gggcctgggaaggggaggcctggccacaagctacagtcccaggggtgagcaggcacagttactagaacagaaatcctgccgggtgtggtggctcacacctgtaatcccagcactttgggaggccgaggagggtggatctcctgaggtcaggagttcgagaccagtctggctaacatggtgaaaccccgtctctactaaagatacaaaaattaactgggcatggtcataggcgcctgtaatcccagctacatgggaggctgaggtgggagaattgcttgaacccaggaggcggaggcagaggcttgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttggtacatttttgtatttcactatctttatactatataatatggnnctttgggtaccgggggaactttaaatttcatctcaaaatatttttaaaagcctgaggtntatntacataaagatggatgaaattatttcctgtagctgattactcatttaaaatttaacttcttntnggacccaatananctgctgatctgtcanctnctctaataagactactgatacaaaaaaaaaaaaaaaaaaggcctttttttatcgataaattc

SEQ ID NO: 23193 - DNA, 440 bp, Homo sapiens
  misc_feature 2, 12, 23, 25, 31, 37, 49, 51, 52, 60: n = A,T,C or G
anataactgggncgtacgatccncncttgtnttgttncttttggcacgnanngggcaggnagtgagccaccgcgcccggccgactttttgttttttaatgcacatgcagaatattagaagttcagtgtttttattgtctgagaatttagttcaaagagaattgaaaggcctggaaatggatagtggtggaggttgcacagtattgtgaatgaacttaatgccagctaattgtacacttaaaaatggttaaagtatgtgctcgatctctaatttctaaaacaaagcagggacaggcctggttagtacttggataggagaatgtaggctttttaaaaaactggcaaaaatggcaaattttatattacagtagtccctgccttgtccccgagggggtcgtgccattgcgctccagcctgggcaacaagagcgaaactccgttt

SEQ ID NO: 23194 - DNA, 246 bp, Homo sapiens
  misc_feature 181, 182, 184, 185, 198, 199, 200, 207, 208, 211, 213, 214,219, 225, 227, 234, 236, 241: n = A,T,C or G
ggggagactccaaataagcactgggtatttgggttggagatacagagctgagaatgatatgcatgtaggtgggcaaagcaagggggatttcatgagttctaaggtagggtgagaaaaataaccgagagttgagcagtgacggaggaagctacaaaaaaaaaaaaaaaaaaaaaaaaaaaanncnnccctttttttccnnnatccccnnctnannaaaancttttntngttttgncnccccntttgt

SEQ ID NO: 23195 - DNA, 757 bp, Homo sapiens
  misc_feature 1, 9, 54, 613, 637, 661, 670, 675, 708, 713, 726, 729: n = A,T,C or G
nacgacagnaggggtgagttctgttctccaaccaaagtgctggattccaagggnactggaagggaaagtccctaaaaatcacgagttcaggcgtctgagacttggtgggaacggaccttcctcttagtgcccaagcctgttctaatttttaaaaactgatgtctattaagacccaatgttaactttatgaaaatggttcctaaggagattcacatctctgtgtccgaattctgtgtgcagcaaacatcatctcaagtgcgttttcccaactacgcttctttccaggataaaatactctaagtgacaaatgttgagtacattatcaggttctctgctgtttaaaaagtatccctgtgctttgaagatactgctataatttgaaaatttgaaattagtgtttcagctgaaccatccgttcatcttcaagccatcatgagctgtaagaagcagaggtcacggaagcactcagtcaatgaaaaatgtaatatgaaaatcgagcactatttttctccggtctctaaagagcaacagaataattgcagtacttctctaatgaggatggagtctagaggagacccaagagccacaactaatacccaggctcaaagattcnttcacctaagaaaatcagaagacngacctgccccaaataggacatttntgttacctngaagntaacccaggagaaccagattgaacttagctccnctagnagatagtgctatnttngctctcacctctcaggctgcaaaaaaat

SEQ ID NO: 23196 - DNA, 685 bp, Homo sapiens
  misc_feature 21, 23, 39, 49, 51, 54, 76, 85, 96, 100, 108, 113, 114, 123,125, 140, 146, 152, 158, 179, 188, 193, 206, 224, 242, 248,250, 261, 262, 269, 270, 278, 359, 396, 404, 431, 467, 471,582, 583, 586, 593, 611, 621, 622, 624, 639, 648: n = A,T,C or G
  misc_feature 649, 651, 676, 677, 679: n = A,T,C or G
ttccccacaagttaaagtttncnacttttgtacttcctnaactgggtantnttntaatcacctaacgatacggtgngaatgccantcctcaacaantcgntacaggtntctgnncacgtgtgntnccacctttccatgtnagctgnagctgngaactnttatcttgtccctgcagggangctgtggtnaggangacaaacgcattngggaaatactcctttatntactccagagcttaagcntgacantnaacagtcatcnnagaatcnnaattggtngacagtcctaatcccgtggcttattttctatccctaactcatttaccaataagcttatttttagtgatttctaaaacaagngttaagtctggatacctgattattacctcaaatattntccaactncttaaactgtttaaacactaaaatgtntttcgttgttgtctaccagtaaaaacagaccacacngcanggatcctcctgctatgaaagctgtatgtaattctctgctgggagtgggtaaaattaggggattgttctggtggtctttctactgcagtggagcttctgtggcatccctttnnggncaatatntttattggacagatgggnggaggatatnntnatacccttccaaccncttgctgtnncnccatttcttggttcctcactttacnntncgttag

SEQ ID NO: 23197 - DNA, 664 bp, Homo sapiens
  misc_feature 606: n = A,T,C or G
gggcaaatgagagatgtagggattccaaaatgccatttgaggggttcatgaagtaagagtggaactttggtaagcagatatcagggtagtaactgtgagtgatgcagggtgaaaggactaatatgagcattactgtggaagtgggaagacatgagatgtactctggaaatagcaaatagtctgttttggccagggcatagaatccatgtcatgaaacaatgagggacagggacagggaggcaagttagggtcatttttcggagtcttttgaaaaccagggtgaggaacttggatggaattctgaaaagtatggataggcttccacttgtgcttttgaaagaatttgacagctgtatggagaggtggcaaggagaggcacagagagattgattttcttattaaggagggggacaggttgtgtcaagtagaagacaaggaagcacacagtggatagattcactggacctggcaatggagagaacccagtcaataccagtgctgccaatcaaagaccaggactgagacgccactaatccacatttaaaaaagtagccgttgttctttttcttactagaggtagtcgtggacctctgaaactgaaccaanccaaggattgtgaatactgatggtgagcatgaggagatttcttcaggattctataaca

SEQ ID NO: 23198 - DNA, 860 bp, Homo sapiens
  misc_feature 8, 12, 15, 21, 28, 34, 42, 46, 48, 49, 56, 66, 71, 79, 81,99, 123, 152, 168, 171, 177, 187, 192, 232, 243, 245, 252,257, 261, 267, 281, 284, 293, 336, 347, 360, 391, 409, 419,426, 428, 437, 440, 453, 466, 534, 546, 556, 557, 579: n = A,T,C or G
  misc_feature 582, 604, 610, 617, 619, 624, 650, 659, 675, 705, 712, 743,821, 824, 828, 829, 832, 835, 849: n = A,T,C or G
tcatcttngccnacnataccnccttgtnttgttncttttggnccgnanncggcctnacggctgcgnatagnacgacagnanggcctggttcctgtctgnttttatccctactctcctgtcctncatcagtgaatagacccactttagcagtntggacaccatgacttncangatagnaactaaatanatcgntattttcctggttattttcttaagcactaagcagaagcancactattctgnantctgatnctatntcanaagtgnacattcccacttanggnttttcacangaattttttttcttgcacttaagattcgtttcttccaggctgnaagagaaatanatgaatatgtctnaaaagttaggaaggcaacaaaggacttgatnctgcagctttactctttntttatataanctcgaantntacctgatntanaaccatgacgaantgctgaacctttnttaaggagtggccttgactggtcctggtgacaccacttccaacccagtaaatgcacccctcttctgcnatggatatggcnaggcttaatnnacatggattatttgacacattntgngtcaccatgagttgaacaactnccagcnagaatgnanttggngtatagagaggcatgttggcagggtnatcaggttnctcattgcaaagccanttgtgtgtacctgacaatggatgtagactntcaattncttggcctaattttcactctatttttaaaanaaaggcggggggtggctaagcctgtatcccgcctttgggagtctgagcagcggatacttgagtcagagtttgaacccnggncccnnccntgngaaaccggcttttnaatacaaaata

SEQ ID NO: 23199 - DNA, 768 bp, Homo sapiens
  misc_feature 27, 632, 635, 642, 652, 659, 696, 716, 719, 724, 746, 748,758: n = A,T,C or G
gggggcgcgtgcgcagcgccggcccgngttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatcacagggaagatcggtctgaaattgagaggttaactgcaaaaatagaggaattccgtcagaaatcgctggactgggagaagcaccgcttgatttatcagcaccaggtatcttcactggaggcacaaaggaaggctctggctgaacaatcagagatattcaggctcagcttgtcaatcgaacagaantanagtctgnggacttctanccatcanaattcacacttaacagtaactggaccggctatgcctntctggccatgagtggaatanacnctacntgagggcatgacttgttggacnanttactgtctnagacacacaa

SEQ ID NO: 23200 - DNA, 830 bp, Homo sapiens
  misc_feature 2, 8, 10, 12, 15, 33, 48, 58, 468, 631, 638, 691, 693, 747,748, 750, 758, 773, 782, 789, 796, 799, 808, 822: n = A,T,C or G
anattctngngntanaaaacccccttgttttgntgcttttggaccgancctactgagnaataggaaccactaagtaagcagaaaagaagcaagatattctcgtgggggagaacaacggctgggaggggaggaagcatggccaaggcaaagaggtgggcattaataaggtatgttccacgttctggggctaatgagaagacaatgttagctttatttctttttacttggaatgatatatgttatttataaggttaagtgagattttacacagctttaatgcctaggctggccctggacctggaaatttgagccattgaagtttgggggtttggtaatgacagtgaggcctttgagctgcactgaagctggtctcttaggacaacaacaattagaggaggaaggaaggtaaaggaggcctaagacagtcagggggagggagactccccattcactgacctgtcagttcangcctgggctcttgccacctgtgatcctgttcatcatttggttaggtacccaaagcttatgtgaagaacaaattgtttggaataaatttgtgggaacctctgataatcactgtatatgaaatagaatacaattttgaggaaaaatcattaggtttgaaaacagntaaaatnttttaaagatatggagaattgaacatttctctgaaattagacttttgaacttntntaatattactcatctgctccttaatgcagccatttctgagctaagtttaaaatnnancaaggganaggggggggaaaaantttctaatntatgtcnttggggnccnatttttaanccccgtcagatttntttgggat

SEQ ID NO: 23201 - DNA, 687 bp, Homo sapiens
  misc_feature 516, 564, 618, 649, 663, 669: n = A,T,C or G
gggattttaaaatttgttgagaacccgaaaatgctttgtttatgtagttataattaccagtatttactgtattataaatgaaaaattagaaattaaaaaaattacatattaaaaaatgataaactcattacatgttaacatacataaaagttttaagaaaataaactatttttcaatgcaaaaaagaaattggtgaggagagtggcattgttttacctttccacacatctttttaatgtttggcttaatattgctgttatatctgtttctgcactttagttttttgtgatattgtacatcatatagtgtttggaaaattacaccttaaactcaagagaatgagggtaaaacatcaaataatgtcttagtagtatttggtgacttaaatagttttgacctattgaaccctcaagagtccctggaccatactttgtgaattactgttttaattgatggactaataatgctatcagattcctattttgcaagatgctgtagtcacccttaaattatgangctcattatcataatcattctgatccaacaagtttctccttaccttanactctacacctacctccctctctaatcaactattatatttgaaattttactgcnttttactgcatgttaaaagcctacttcggcngacctaacgctgangctttntgggctagctgcaaaaaa

SEQ ID NO: 23202 - DNA, 790 bp, Homo sapiens
  misc_feature 1, 8, 17, 18, 19, 22, 29, 31, 543, 571, 639, 646, 668, 690,713, 740, 780, 784: n = A,T,C or G
ncggcctncggctgcgnnnagncgacagnanggataatctgtacaccaaccccctgcaacatgaatttatctgtataacaaacctacacatgtacccctaaaacaaaaataaaagttttttaaaaaaagaaaaggcctgttggatgatgagagaagttctgttcactctcctctaagcaccactagtgtgattgaaacatgaggaagagaagttaaaattaaattgaatggccttctatgtgccaggtacatttccttttcaactcctgtagtatagaataagaaaaagagagttgatcaacaattgtactcctatatgtgataatactacataatttagtatataaaacaagaggggagacgtagcagattatgaagaaaaagcattggtcaaacagaaaagaaagatttagttgaactttaaattataatccagtgaattccttaggaaattgatgaggattcattttcctaatcgaaatttaattgtgttgtgttttctgtttctccatacatgtgttgtctttattaaatgtcatttgngtgtatgtatgtatgtatgtatgtgggnatgtacacacctacctaccattacgctatagacatctgtgttttcacattgaacctatcaatagagcncatttgnttattttggatgctatttaagngatctgtttatagcaaagactntaacattgtcctgcggactgggncggtcctctttaaaatatttgctgacntggctgttggggtgaatcggccctttcctgctgaaggaanggtntgaaaa

SEQ ID NO: 23203 - DNA, 784 bp, Homo sapiens
  misc_feature 2, 9, 14, 723, 743, 752, 767, 775, 779, 780: n = A,T,C or G
gnagacagnagggnatttattataatttgtttgactttattatagaattgactttccaagtgttcatgagaattattgagaattcgctacatagtatcatttcagttgtgtccacatgaattatcagtcaccttgtcttaatgaataatggttcactacaaatattggttttggcatttaaagtgatctatatctaaatgcagataggaccagggaccactcttgaacattaatgtccaagcatcttaaaattacacatgaggctttcataatctgacttctgccccactctccatctttagcccttttccctgtgtgccctttctctgtcattgctgagctgctggtagtgccctactcactcatccttctattgtaggcaaatactttcattctttcaggcctcgctcccgctcttgctgctgccgggcatgctgtcaccctttcctgccctctaccccttttaatctggccagcctcaatatttaagtctctgcttgggcatgtgttctgaaaagccatccctgagatgctttattttcattctttttagaccctaatgcctagcatgtatgtagcaggactcaatacaaattttctgagtaaaacaaagactgttttacaaagatgatgtgcaagactctccctgcagtcttggagcagagggacagacatatggagaaatatgtcagctaaccggtaagagccgaaaaatagtaaatnctaagcagcctcaggagganaactggttnttgggaagactgcanatcagganactnntaac

SEQ ID NO: 23204 - DNA, 783 bp, Homo sapiens
  misc_feature 1, 5, 19, 31, 56, 545, 603, 641, 699, 712, 717, 732, 743,779: n = A,T,C or G
ngggnaaaaacctcccctnatcattccaggnaggcgaaagctatgcactgcgcagnaggctgggaaggctttaattaaattcaaccactgtgagaaatacatctacagcttcagtgtgccccagtgctgccctctctgccagcaggacctgggctcgaggaagctggaggacgcacctgttagcatcgctaatccatttactaatggacatcaagaaaaatgttcattcctcctcagaccaactcaggggacatttcttagagagtatgatggaaggtctgatcttcatgttggaataactaacacaaatggggttgtgtataattacagtgcacatggtgtccagcgagacggagaagggtgggaagagagcataagcatcccattactgcagcccaacatgtatggaatgatggagcaatgggacaagtacctggaagacttctccacctcgggggcctggctgcctcacaggtatgaagacaaccaccataactgctactcttacgcactcacgttcattaactgcgttctgatggcagaangtagacagcaactggacaagggtgaatttacggagaagtacgtggtcccgcggacaangctggcatccaagttcatcacactctaccgggcgatcnggagcatggcttctacgtcactgactgtcccagcagcaggcacaacccctgaggccgngggttgtgctganagctntgtagcccacctggncctggaggtangggggtactacctttatcagacttggattctaatgnttac

SEQ ID NO: 23205 - DNA, 633 bp, Homo sapiens
  misc_feature 499, 572, 576, 612, 613, 628: n = A,T,C or G
gggtactaggtctcaaccttcctcctcttcatttttttagaaaaataaaattggtaaaaatgaatcaatggaatttgtgaatgccctttccagttagttttgccaagtttacacttactttgaaattttggcccaggcatgattttgtctagaaagttttctctgactcctaggaaaagagacactgaaaacagaacagaaaccctgaaaatctatagaaataaaacactgcctgcctaacagtgcgacaccccattggtattatagagtactctgtacctgtttccgccgtagcatttattctacgataaacagggccatgtcttatttgtctaatgcttggcaccaggcctgcaaggtagacagatgttgactaaatgttcgtatgactgagctaaatgaaattaatgaagactcaaaaataggtcaattagttctttggcaatcagttttcggtttccttcatcgccgattgtacaacctttgcagagctttgtanaaatcaagactcctgcttgttaaacaaagcaaccaactctgcagggcagacctgattaaggaggctgccctanttgngttgaaattgggttggaatcaatactgcaaaaagtnncggatgggcctaggnttgga

SEQ ID NO: 23206 - DNA, 749 bp, Homo sapiens
  misc_feature 4, 11, 28, 608, 662, 679, 686, 748: n = A,T,C or G
gggnagcccgntgataggtccgcagggnatcagtctgttgcgatggagaagaggccgagaaaggatggcaagggccagagaataaccagctcaacaatgtactattctatgacaaaggcagagaggacagaaagtcagaagaccctgccagagagggaccaggctgctagagatgggacctaggcacagctctggaaaccgcttttgtgagcagagacagacacaagggtggagggatggagcacttgccaggttcaggattaacttggctacaggtaacaacaacagcagaagttacttaaacaatataaaatgtgttgtcaccaaggaagacaggtgtggagctctacagtagggagaggccaggctccttctaagagccctactgctctactgtcctcaacacacagtttctacctcccgatgccatcagcccttgtgtcccattagcaggaaggagaaggagcagtttcatgcccagttgaaaatcagggcttctattctgagggaagaaggagaggatggatgttggaagataattcacaatttctgccaaaggaaggggtaaaggtggagtgattccaaacagatgccttgcctgagatggntaaccatttaaagtaaactagaaccaggcgcagtggctcacacctgtatctcancactttgggaggccgangcaggangattgtttgagcccaggatttgaaccctctgggcacatacaggaaagtgttctgcaaacttnt

SEQ ID NO: 23207 - DNA, 356 bp, Homo sapiens
  misc_feature 114, 181, 193, 223, 244, 261, 282, 294, 296, 302, 325, 342,354: n = A,T,C or G
gggggtctctttcccttcggtgtgccacttgaagatcctggtgtcgccatgggccgccgccccgcccgttgttaccggtattgtaagaacaagccgtacccaaagtctcgcttntgccgaggtgtccctgaggccagattccatttttgacctgggcggaaaaagcaaagtggtgaggttncgccttgtggcncatggtgtcagatgatatgagcactgtctntgaaccctggagctgcccganttgtgccataagtcctngtaaaagttgggcaaaatggnttcatttttggngnggttcnccctttccgtattcgattaaaanaattgtctgggctgggntgaagcttcaanag

SEQ ID NO: 23208 - DNA, 788 bp, Homo sapiens
  misc_feature 626, 683, 729, 747, 752, 762, 764, 787: n = A,T,C or G
gacgacagagggatcagtgttggttccttctgaggctatgagggaaggatctgttccaggccggtctccttggtttttagatgcctctcttctccctctgtctcttcacattgttttccccctgtgtatgtctctgtgtccaggtttccctcttttacaaagacaccagccatattggacttgggcccaccctgatgacttcattttaacttgaaaatattctctctgcaaattgttacattctgaggtactgggaggtagctcttcaatatatagcttttaaggagtcataagtcaacccataacaattatcaaattaccacacaaagcattatattatcagaggaaaaagtgacatatcataatgataaaagagccagttcatcaaggtgatgatcttaaatttacatacatctaaaaatagagcttcagaattcataagacaaaagtggatagaagtggaatgaaatatagacagcctctccctgttatgtcagtaatttagagaacaggtagacaaaaaatcagtaagcatactgaagactggaacattattaaccaccttgatctgtgtcacatgtataaaacattttagtcaattgcacaaaaacattcattttaatacncgtagaacatttatcacgttgaccatattcagccctaaaaaagtctcaaaatgttanaagatgagatcttggatctctggttattacaacccaaatcagttcngaaaggttttggaaaacncttgnattggaatangncctctcctaaaaagggccaaaana

SEQ ID NO: 23209 - DNA, 725 bp, Homo sapiens
  misc_feature 2, 9, 11, 24, 26, 625, 646: n = A,T,C or G
gnagacagnangggggacctcagnanctccaccctaaaatagttattttgaatttccccctggcaatgtaaaccgagagcttatctgcacaggtgtgggacagaaccaatccctctgcacacctgagacaaatgcctatctgattgcttcccctgccctattgtttacataaaaacgcagggtcactgaggcagtcgaaggcattaagtgactattcctcctcccgctctcacatataaattgtgtatttagtgaaaggttgatcaaagactcaaagaatgtgatcatttgttatctacctgtgacccggaagccccccaattccagttattccacctttccagactgaaccaatgcatatcttacatgtattgattgatgtattatgtctctacaaaatgtgtaaaaccaaactgcagcctgaacaccttgggcacacattgtcaggacctcctgaggctgtgtcacgggggcatttttaaccttggcaaaatagatttctaaattgactgagacctagtagatacttttagttcacaagctcatgaacgcagaagaaattgagagaataagaaaaaagctaggtgtcatggagagcacgaaatcagttccaaaatctgaactncttcatatttattcaacatanggaaatgctcttcactttgtgtgattagattcatttgcgaatgatatatatttctagtatttgattaaataacccattt

SEQ ID NO: 23210 - DNA, 191 bp, Homo sapiens
  misc_feature 1, 118, 123, 126, 136, 137, 140, 148, 149, 151, 155, 156,159, 162, 170, 173, 181, 187, 188: n = A,T,C or G
nggtcattatctttggatgctaaacaattttctgtgaactattttgacaagtgcatgatttcactttaaacaatttgatatagctattaaatatatttaagggtttttttttttggcnaattncanctttcaccgnntgnaacaaaanncnaatnnttnccntgtttagnaangttttttnaaaaannacg

SEQ ID NO: 23211 - DNA, 789 bp, Homo sapiens
  misc_feature 1, 8, 18, 21, 29, 42, 492, 554, 659, 691, 693, 709, 714,720, 753, 755, 756, 757, 759, 766, 767, 777, 778: n = A,T,C or G
ncggcctncggctgcganagnacgacagnagggggacaaagnaggtctgcttctgaccaaatggtttatgctacagcagagaagtatccgtcatttcttcttgtagatttgagttagcatctgatatcacttcttcccagcctgatgatttctgttagaactttctataaggctcttctggagaaggatgctgaaccctcagatatcaggccagcattcccaaaagaaagaaggaagaatggtgaaaggcaaaggatcaaagaaatagagacagggtcttgctctgtcatccaggctggaattcagtggtatgttcatagctgactgtaacctcaaattcattggctcaagagatactcctacctcagcctctggattatctaggactaccggaataaaccctatgcttggctaactttttaattatttgtagaaatgaggtcttgctatatgactacgctggtctcgtacttctggcctcaagtgatcctnccacctctgcctctcaaagtgctgggattataggcatgcgccaccatgccaaagacagtatnctatttcataagaagaaggataagggggtagttggttttttttacttatctggtaagcatggaacaaggcctataattggtcttgtaattccaacacaggaatgntatactacatcctcctgaattatacctaaggngnaatagagctaataacntcttntttcanaaaaaaaaaaaaaaaaaaccctggggcgttttncnnnancccacannaaaaacttgnngtgcccccccc

SEQ ID NO: 23212 - DNA, 774 bp, Homo sapiens
  misc_feature 5, 9, 12, 16, 17, 28, 39, 41, 57, 60, 67, 678, 698: n = A,T,C or G
tttgncctncgntaanncttgtttgttncttttggccgnancggcctaggctgcganagnagacagnagggtacgcctgggtccaaatataactattaaggacagtctttggccagagcagaaatcttactatctgagaatcataatgaaaagttactacataattgttattgatgtgagaaaactttgtgaccaggttgtcacttgcttgtcctataaagagccatgctggaatttgacccaccttgggattttctctatgaacttatgaaaaccttcagttacagacagagtttcactcttgttgcccaggctggagtgcagtggcgccatctcagctcactgcaacttctgcctcccgagttcaagggattctcctgcctcagcctcccgagtagctgggattacaggcgcccaccaccatgcccggctagtttttttgtatttttagtagagacggggtttcaccatgttggccaggctggtcttgaactcttgacctcatgtagtccacccgcctctgcctcccaaagtgctgcgattacaggcgtgagccaccgtgcccggcagagaaaaactgcttaaggttgaaaagagaaatttaagaaattgctgacggaataaaaacataatagaactaccacaccgaaggaaatgaaagaagcaagaaggaaagcnccagaagtgatttggaaganaatcctaaatgaatgtgaccacagaggatcagaagaggtagggattatagtttcttaacagcctctccatggagct

SEQ ID NO: 23213 - DNA, 764 bp, Homo sapiens
  misc_feature 499, 515, 526, 551, 578, 613, 621, 625, 627, 630, 655, 707,711, 722, 728, 735, 737, 743: n = A,T,C or G
gggcttcgcatggtggtgtgcacctatagcccccactgcctggaaagctggggtgggagaatcgcttgagtccaggagtttgaggttgcagtgatccacgatcgtaccactacactccagcctgggcaacagagcaagaccctgtctcaaagcataaaatggaataacatatcaaatgaaacagggaaaatgaagctgacaatttatggaagccagggcttgtcacagtctctactgttattatgcattacctgggaatttatataagcccttaataataatgccaatgaacatctcatgtgtgctcacaatgttctggcactattataagtgcttcacaggttttatgtgttcttcgtaactttatggagtaggtaccatttgtgtctctttattataagtgagagaaatgaagtttatattatcaaggggactaaagtcacacggcttgtgggcactgtgccaagatttaaaattaaatttgatgggtgaatacagntacttaatgaccatgntatattgcttnccgtgtaacatctgccatttatttnctcagctgtcaaatcctctggtttctntctggtacacactacatcaatggctttgtacttgngatgaaanaaancntgncctaatgggggcacacatgcaaaanatcctgtttacagctgcctttcggaacttattgcttgcttttttcaaatcangganaagggggggcnatttgnccttacncncctganaggctcatttttaagggcccg

SEQ ID NO: 23214 - DNA, 566 bp, Homo sapiens
  misc_feature 324, 353, 367, 405, 432, 438, 447, 471, 487, 514, 520: n = A,T,C or G
gggaacctgtgtctgcaacttcctctaattgggaaatagttaagcagattcatagagctgaatgataaaattgtactacgagatgcactgggactcaacgtgaccttatcaagtgagatggagtcttgccctgtctccaaggctggagcccaatggtgtgatcttggctcactgcaacctccacctcccaggttcaaacgtttctcctgcctcagcctcccaagtaactgggattacaggtacccaccaccatgcccagctaattttttgtatttttagtggagatggggtttcaccatggtggccaggcttagtctcaaactnctggcctcatgtctgcctgccttggcctnccaaagtgctgaantacaggtgtgagccactgtgcccggccacatttcttanctagaatttagtttttatggtttattncgcagngaacgctcnccaaaatttcttttgattattacntaaaagaatattttgnttaactttaactgaatttcataccttncatctnttaatgtttaccttttcgaaaaaaaaaaaaaaaaaaaaaaaacccc

SEQ ID NO: 23215 - DNA, 818 bp, Homo sapiens
  misc_feature 17, 20, 27, 53, 60, 62, 629, 699, 778, 799, 809, 813, 815: n = A,T,C or G
gcggcctacgctgcganagnagacagnaggggtcttacatgatggcagcaggnagcaagnanagagagagggtaggtgccacatacttttaaacaacccgaccttacaagaaatcactattgtgtcaacagcaccaacggggatagtgttaaaccatgagaatccaccccaatgatccaatcccctcctaccaggccctatctccaatgttgtggattacaatttgacatgagatttgggccaagacacatatctagactatatcgggggatttatataatctataaacattggttacctgtccatctttttgagtaggtgtgtgctgcagacttattggggacataatcagatatacctgatttgctgcagtatactcaaggtgtattagttgagaaaggttgctgctactggagactggtttctattcagactaatttctattaagtctaattatgtagaagtgatatatatttcatattaagtataattttctatgtgtaacaaactgtttttagaaaaaaactgccaaaaattgtgctgaatttagtcagacactccaaagagcaaacacacttttgttttttagcataaagaaaactatttcaaatcccaattaaaatagttgnacaataatttgctttttgtatttatattgggataactacaaatttttaataattgatataatggatatgnatgggttatcttttattaagggctactacgtgctacacatggtctaagcatggatgtacagtaataagtagaccagatncaaaaaaaaaaaaaaaaaaanccgggggccntttnantat

SEQ ID NO: 23216 - DNA, 785 bp, Homo sapiens
  misc_feature 1, 434, 490, 497, 517, 570, 585, 587, 622, 625, 645, 653,656, 671, 674, 678, 688, 692, 706, 719, 730, 741, 742, 771,774, 775: n = A,T,C or G
nacgacagaggggtcctaaaagtcttctcaccctcataggactgctctacatctggcctctgccaatggaaattcagaagtagtaaaactcctgctggacagacgatgtcaacttaatatccttgacaacaaaaagaggacagctctgacaaaggccgtacaatgccaggaagatgaatgtgcgttaatgttgctggaacatggcactgatccgaatattccagatgagtatggaaataccactctacactatgctatctacaatgaagataaattaatggccaaagcactgctcttatacggtgctgatatcgaatcaaaaaacaagattgagtctcactctgtttcccaggctggagtgcagtggtgtgatcacagctcactgcaacctcgacctcccgaagctcagatggtcctccaacctcaacctcagntttttttttctttctttctttttatttttatttttatttttatttttttttagtanagatganggttttgccatgtttctcangctggtcttgaactcctgggctcaagcaattcatccccctcagcctcccaagngctaggattacaggngngagcccccattcctggcctagtctgactttatctntgngggtgagacattaaatgaanttattggnagnatctatcaggtacanaanatanttttcctttntccntcagtattcctgcnttcaaaggcttanagttgctgganagctttcatannaaggaggcccttcagattggggctttgtnaannttcaagctag

SEQ ID NO: 23217 - DNA, 171 bp, Homo sapiens
  misc_feature 140, 141, 143, 145, 147, 149, 150, 155, 157, 162, 166, 167,168, 169: n = A,T,C or G
gggggccctgctgcccctcctgaatctcgtatgatggtcacagtccggtggccgtgggggtgctctgccttccctggtccccactgcccatatctgtggactgccccttccaaagacccctggggggggggtggggcatnntntncncnnctttngnctgtngatnnnnga

SEQ ID NO: 23218 - DNA, 271 bp, Homo sapiens
  misc_feature 9, 32, 61, 71, 73, 86, 119, 121, 125, 140, 146: n = A,T,C or G
tttttttgncctacgataaatcttgcttgttncttttggccgtaacggcctaggctgcganaatagacagnangggggctgggtcngtttctggatcctcaggtggtgctgggggtganancctnatgccccgccccgcngctganccctgccgcgccgctgcggctcctcctccctccttccgtcctccgcgccttccgtaggtcggtccttgcttcctgcttcgcctccgcgcctcgcgctatgggacaaagcccccgatccgccagca

SEQ ID NO: 23219 - DNA, 795 bp, Homo sapiens
  misc_feature 1, 9, 22, 595, 664, 697, 708, 714, 728, 731, 737, 757, 770,776, 790: n = A,T,C or G
nacgacagnagggcaagtaggnaaatagaagaaaacatgggtcaggtcaaattaaagggtcagtctatccttagctacacaggctcatcaaaactgagagcacgaagagggcaaaggtcttgattcccctgtgagcctgtctgcttacttctaactcttgccttctgactgcaccatgactccaggaactggtttccccaactcctatctgtggatccatggagaccagtagagaggcacatggaccaaggacaatccatcaccattgaaagcacagcattttagtaagaataaccttagataatgtttaattcatctacagacaagcaattttcaggtaaggaaactggagtccagaaaaatgaagcaacttgcccaagggcgcacagtcactaagagatcttagtggtctaagcaggtctcccaagcatcaagatagtgtcttttccattatgactgagaaaggacagaaaagggcatgtcctattaataatgttggaccagtggctgtgcctttcgtgtacaaagatagtaaattaggatgcaggctaaacaaggccctgagagagcaatcttcctgactttctcatactgnccaaattgtagtgcaaacataaaaactggctctggtattctttactttcattactgatattcatatganatacactttctctcaacattcctgagaaaaganaaattttcctntttganatttgcctctggcnatnttcaanatgcttttagtatgtactanctataaggctctnttaaangttctgctttggtntagaa

SEQ ID NO: 23220 - DNA, 677 bp, Homo sapiens
  misc_feature 1, 9, 12, 13, 517, 533, 589, 591, 628, 642, 643, 675: n = A,T,C or G
nacgacagnagnntataatacccaagttacagttttggaaatttgatttcagtggaacatactagtaccttgagatactcattgcaaatggggtcagtcaaataagttttagaaatgcaaaatattatgtttcccttttggaaattctcaatgtacattcacatattaaagactgaaaagccctgaaataaaccagatgcccaaactcatagaatcttaaatttcccccaacaacacttactaacagcccatgagaatacatttcaggaatgttagcataaatgagtatctaaagagttgtatcaatctgtatgactaatagtaattttctcatttaacctacagttacctggtgatagttgatagatgttctagagatagaacgattaactaaagtcatgtatcacagaagatggtaaaccctagatagacataaatccttgtctaatcccagagtccctgctctgaactgctgtgttgcatgcatttgccctcatggtatttcataattttaagnattctcatttttaatncactaataatttcttcaattttacaaggacacacattttgggaattcttttaaggngnctgactcttgacttgaaatttcacattttggatcagngattctcttttcanngttcagccttttttaactgcaaattttatggntt

SEQ ID NO: 23221 - DNA, 805 bp, Homo sapiens
  misc_feature 1, 14, 471, 648, 658, 665, 689, 693, 699, 705, 708, 753,764, 777, 791, 796, 797: n = A,T,C or G
nggcccaggctggnactgcagtggcacaaacatggcttactgcagccttgacctcttggcctcacacgatcttcctgccttagcctctcaggtagctgggaccacaggcacatgtcactatgctcagctaatttcttttttgtagagacagggtctcaccatgttgcccagactggtcttgaactcctgggctcgaatgatttgcctgccttggcctcccagagtgttgggattacagacatgagccaccacgcctaactcagttatttttattgtaagcccaaatagtttttattcatagtctaataggaaatacagtaaacagagacatatgttgtttagggaatagcttgtaaaatatggaaaacaaatggtaactttgaggcattctcacatgatttatataatagttaatacctggtcaaaatattttttgcggtttcatgtaaagtggtgatattttattctgangtctcttggcaggtcgtcttggggaggtttactaactgtagcaactgcttattgagagcgagtgctacatgccagttacccttgtatgcactttacatatattacttaattgcacaatgcttacctgcatttacagctagtgaaatggagctcgtagcataactgcagtactcaggnatcagctagnaatgganaaccaacttaagctgggttagggncctnaagctntgactnttntgctactaactgctgagttgacttaactttaatttaatgctgctnaaacagggggnttttcacccttcnccaaaacagggggntgtgnnggtttaaa

SEQ ID NO: 23222 - DNA, 674 bp, Homo sapiens
  misc_feature 1, 9, 605, 610, 656: n = A,T,C or G
nacgacagnagggaaattaactgttaaggaataataaattaggcataaatgtggatcagtagagttttaaaggtaataggaagccaggtacagtggctcacacctataatctgagcactttgggaggccaaggtgagaggattgcttgaggccgggagtttgagaccggcctgggcaacatggtgagacccccatctctacagaaattttaaaaattaatatggcgtggtgacatacacctgtagtcccagctgctcccagctactagagggctggggtgggaggatggcttgaacctgggaagtgaggcatcagtgagctgtgatcgcaccattccactccagcctaggcggcagagctagactctgtatcaaagaaaaaataatacttttttgaaattaaggtaagataaacctatgacagctttgttaacaattcaaaaacaagttgtacaagtttcaagaaaacccaaaactgtttcttcaaagaaacaagcatgtgagtagttttaagactgctcattaaacatttgatcagtagttaaagttcattggtctattccaccctgccaaataactaataaatggaaaaatactccaaaattnctgcntgctcagatggttccaccaagttgatcaagactggtattgctttgnagttttcagtggagatgc

SEQ ID NO: 23223 - DNA, 764 bp, Homo sapiens
  misc_feature 3, 10, 12, 30, 689, 710, 715, 740: n = A,T,C or G
agncgacagnangggttggtagtgccccangcactctggcacccagttttggaactgcagttttaaaagtcataaattgaatgaaaatgatagcaaaggtggaggtttttaaagagctatttataggtccctggacagcatcttttttcaattaggcagcaacctttttgccctatgccgtaacctgtgtctgcaacttcctctaattgggaaatagttaagcagattcatagagctgaatgataaaattgtactacgagatgcactgggactcaacgtgaccttatcaagtgagatggagtcttgccctgtctccaaggctggagcccaatggtgtgatcttggctcactgcaacctccacctcccaggttcaaacgtttctcctgcctcagcctcccaagtaactgggattacaggtacccaccaccatgcccagctaattttttgtatttttagtagagatggggtttcaccatggtggccaggcttagtctcaaactcctggcctcatgtctgcctgccttggcctcccaaagtgctgaaattacaggtgtgagccactgtgcccggcaacatttcttaacctatagtttagttttatagtttattaccgcagtgacgctcaccaaaatttcatttgattattacataaaagaatatttgattaactttaactgaatttcatagnttccatctattaatgtttacnttaanataactcctgacttattgtacattntgtcccatatagctggagtatact

SEQ ID NO: 23224 - DNA, 755 bp, Homo sapiens
  misc_feature 22, 645, 651, 675, 691, 704, 708, 731, 753: n = A,T,C or G
ggggctcccctacattccaggnaggcgaaagctatgcactgcgcagaggctgggaaggctttaattaaattcaaccactgtgagaaatacatctacagcttcagtgtgccccagtgctgccctctctgccagcaggacctgggctcgaggaagctggaggacgcacctgttagcatcgctaatccatttactaatggacatcaagaaaaatgttcattcctcctcagaccaactcaggggacatttcttagagagtatgatggaaggtctgatcttcatgttggaataactaacacaaatggggttgtgtataattacagtgcacatggtgtccagcgagacggagaagggtgggaagagagcataagcatcccattactgcagcccaacatgtatggaatgatggagcaatgggacaagtacctggaagacttctccacctcgggggcctggctgcctcacaggtatgaagacaaccaccataactgctactcttacgcactcacgttcattaactgcgttctgatggcagaaggtagacagcaactggacaagggtgaatttacggagaagtacgtggtcccgcggacaaggctggcattcaagttcatcacactctaccgggcgatacgggagcatggcttntacgtnactgactggccccagcagcaggcncaacccctgaggcggnggtttggctgaancttntaacccaccctggccctgaaggnaggggggtgctacctttaaaanac

SEQ ID NO: 23225 - DNA, 783 bp, Homo sapiens
  misc_feature 9, 30, 549, 572, 577, 606, 618, 620, 661, 672, 681, 688,726, 732, 747, 757, 779: n = A,T,C or G
tacgacagnaggggccttcccaggcggggnatgctgcggctccgcagcgggctgaggcaccttcgcgcaacacccaatactcggggctccgctcggcttcttcgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccgaacaaaatgctgtaacagatttgacagcagaggctgtaaattagctattgcagcacctccatcagagggagaggctaatgctgagctctgtcggtatctttccaaggtcctagaactcaggaagagtgatgtggttttggataagggtggtaaatctcgtgaaaaggtggtggagcttttggcttctacaactccagaagagatcttggagaaattaaaaaaggaagccaaaaaaacataaaagcaagaaatgaggccgggcgcagtggctcatgcctgtaatcccagcactttgggangccgtggtggcggatcacctgangtcangagttcgagaccagcctgaccaacatggngaaacccatctntngaaaatacaaattagccagatgtgatggcgctgcctgtatnccagtactcangaggctgangcagganatacttgacctggggcggaggtgcagtaaccgaatccnccgtgncttcacctggcacanatgaactctntccccgaaaaaaataaaaactncttg

SEQ ID NO: 23226 - DNA, 767 bp, Homo sapiens
  misc_feature 1, 9, 23, 510, 600, 627, 638, 644, 651, 654, 664, 730, 755: n = A,T,C or G
nacgacagnaggggtgatcaggnattccctgtgtctgtagcattcatatctgtatatagctgactggttttatttggtgctgaaatctctgcttttcttcagagaccctgtctttttaaccttactcattttgtattcccagtggctgacaggttacgttactatgtaagtggtagattctcagtctgtattggttgcaggaaactaatgagtgaatgaatagtataaaaagtggatataaaattagctagttctgacttgtccttagtaaacttatggtagccgctaagttctcctctgaagccatttttagaattacaaatttaaagtgatattaaactgattgaatgtgtcttgcattcagacaaagaagagagaaaatgtcatcattatgccaattggtttgattgcagattttagattttcagtttcttataaattccctttcccatttcccttggtggctgtttcacacttcagtattaaaaggatattctctctcaaaattgnatattctgctttataaagtaaatgctttaatttccaagccaatattatttaaaaaatcagtcacagcaaacctaaaatttttatcttagngatgacaggtacttgaaagcatataanagggctagganaatctnggtctanacnttaatttgcnaacctcaaaaaaaactatattggttcttcaaaaaatggctaaccatgattttgacaaccggaatgntaaaaaaggttggccgggggggggnccacctgaatcc

SEQ ID NO: 23227 - DNA, 768 bp, Homo sapiens
  misc_feature 522, 573, 600, 615, 625, 631, 642, 647, 651, 652, 656, 658,659, 670, 683, 696, 701, 710, 717, 720, 759, 761: n = A,T,C or G
ggggagtctcgaaaggcactctgtcacgtgtacacaggaaagggccctgacaagaggatgggactgcagttgtggctgccagagtcttgctttgtcgcccaggttggagtgcagtggcacgatctcggctcagtgcaacctccgcctcctgagttcaagtgattctcctgcctcagcctccctagtagctgggattacaggacaaggagagggacaaattccttcttggcatccttatggccctgtgacctgctaatgaatgctgactctgagctgctactagaatttggtttccttgtggcttcccaggaattggtctcactctgctcactctgtctcccaagctggagtgcagtggtacagtcacggctcactgcagcctccacttcctggactcaagtgatcttctcacttcagccttctgagtagctgggactacagccccctctgcagctcttcatgggggtccactcaagtcagaagccacatctgggtgtgattcagagagctggttatgcaaancagccttgtcaccatcaggcaagcacctgaattccaccgaaagagtgctgnggcctgaggacttttctgtaccagccntttcaggagaccagngaatacaacntccttntaagtggcaanagcanagannaacncnnaaagcacctgntgaaagatcaaangttctactttaantgganaaaagcatnacccaantgnggccgctttaaactgaagggaagggatgatttaccttancncagggcg

SEQ ID NO: 23228 - DNA, 206 bp, Homo sapiens
  misc_feature 5, 20, 21, 22, 36, 47, 49, 56, 107, 117, 120, 126, 138, 151,170, 172, 174, 198: n = A,T,C or G
atttnttgccgtaacgatannnccttgtctttgttncttttggccgnancggcctncggctgcgagtaagtacgacagtaagggtacggctgcgcagttaagcctanagtaagggtncgnctgcanattaagcctganagaaagggttcgnctgcgtattaagactatangnanggtctcggctgcgattaagactanagtaaggg

SEQ ID NO: 23229 - DNA, 312 bp, Homo sapiens
  misc_feature 161, 225, 226, 245, 252, 256, 257, 279, 283, 287, 289, 290,298, 299, 306, 308, 309: n = A,T,C or G
aggggtcgaggacaggaagtgagtcatcacaaactggggacctccaccacatctagcagaagtaagtcagaccagggatgcacgaaggagagagagtgagaaagtctctagaaaatgaaacactcaataagggagggaagattgccactcttccaactttntaaaccttcccaaacctgattcagccccctaaaggtaattgccagcccccttccaccaaaggannaatgcctttggggtgaaancgaaaantttnnttaacccctttcctggtttggntttnttcngnnaaccttcnnacccccngnngcc

SEQ ID NO: 23230 - DNA, 625 bp, Homo sapiens
  misc_feature 2, 3, 4, 5, 16, 23, 24, 40, 43, 68, 73, 75, 100, 177, 220,300, 310, 317, 319, 328, 351, 353, 364, 369, 372, 374, 379,387, 416, 453, 459, 463, 467, 475, 476, 486, 493, 504, 515,549, 567, 579, 591, 594, 596, 597, 599, 616, 618, 624: n = A,T,C or G
gnnnntttttttttgncactgannaaacttgtcttcttgnttntggccgaacggcctacggctgctanaatananagaaaggggtcccggcccccctggncttgtgtcaaggcctgccttgtgtagcatcggttttggggaagatatcatgttcgaagtggttgaaagatgtagtanaaggatggatggtggaaggtggggacgttggtggctggctgangtgcatgggccccacacaggacagctggagaatgggccgtccacttgggctcgttctgcgaggggctcatggtgccttgngatctcacanttggtcngngtctacttnttgatccggaagcgaagtcatangncgagctgaggntgccntgntnttctncgacaacnatgtcattccacccaccagtgccacaatnggtcagctgcaccacgaaacaccatgaaaaagacttntttttnttcncctncttactgnnctgacagatncttcgantgacccccttntctttatgctnatgttaagttttgggattgttactggatgaaagngggggcagatgcctgtcnccaaagtgtttnactgtgtaaaanaancnntnttgattgacaaatcctntntgtctna

SEQ ID NO: 23231 - DNA, 666 bp, Homo sapiens
  misc_feature 493, 547, 559, 574, 577, 592, 596, 600, 618, 622, 634, 642: n = A,T,C or G
gggagatttaggtgtgaaaaaggagtccccttggtctttcatagtccacacctcttctctcccttctgtctttgaagccctgtgagctaagagattgaggtgtttgaaaaactgagactcttcccatatccagcctaatgacctcagtgggttgcaatattccgtttcactgaatgtagtagggttttatttgttcataccagggaccttttctgattgttctacctttatcttactttctagccactctctcatccttctcttactcagggtcagtaaatgctaggtagatcagtagtagaaagaggatagctttttcatgtagttttaaatttttaacctgaatggttggtactagctaggatggtcatggagctacacatgaaagctcttgtctatcagctcactgttctggtgttgtaatatcatcctctaacctttctctcagttccctttggtgatactcagactctgcacttagtgtctgcaggcncatctgaaaattcacatgcagacacctccatatggactcaatttctttgtaganactctcttgggnggcctatcatgaagnccnctcctaggcttttcnttgntttnttcttacaacctttacangggntgatgcacagcngcaaattnttcaattccctgttgtggctattg

SEQ ID NO: 23232 - DNA, 757 bp, Homo sapiens
  misc_feature 4, 54, 199, 522, 539, 555, 583, 626, 644, 657, 732, 736, 749: n = A,T,C or G
cagngttgcgctctgtcgcccaggttggagtgcaggggcgcgatctcggctcantgcaaactccgcctcccagattcacgccattctcctgcctcagcctcccgagtagctgggactacaggcgcccaccaccacgcccggctaattttttgtatttttagtagagacagggtttcactgtgttggccagggtgatctnggatctcctgacctcgtgatgtgcccacctcggcctcccaaagtgctgggattacaggcgtgagccacgcgcgcccggccgatcctgaaggttttctcctgttattttcctaaaaggtttacggggtcgaggtttatttatttatttggtgcctatggaggtgcaatgactcccgcgtcgtttgttgaagaggctgctcttccttcattgagacgctttgctcttttgtccaatatcagttgggcatatttgtgtgggtcttataggtacaatttttttttttgaaacggagtctcagtttgtcacccaaactggagtgccgnggtgcgatctcaaggcnctgcaacctccgcctnctgggttcaagcaattctcctgcgtcancctccgaggtagctggattacaggagtgcctcaccacactcanctaatttttgttttttanaaaaaaggggttnaccatggggccaggctggcttgactccgacctaagggatcccctgcctgggctccaagggctgggatacagcttnaccnggggcccgcctantattttta

SEQ ID NO: 23233 - DNA, 803 bp, Homo sapiens
  misc_feature 2, 3, 10, 21, 22, 23, 24, 30, 36, 44, 48, 50, 57, 71, 79,81, 84, 100, 646, 725, 750, 783, 784, 786, 787, 790, 791,794, 795, 797, 798, 799, 800: n = A,T,C or G
annaacttgncctaacgatannnncttgtnttgttncttttggnccgnancggcctnacggctgcgatagnacgacagnanggnattgtgatttctaggnattcgtttttatggtttgggagtggaatgtatggcttaagcaaacacaattaaatccaaattacccgtggccacgcagccactggctgtctttccgtgtgggaaaaggcagggctttgtagggctagaaaatatctgaaaaaaatatgaagtgactctgtctttttttctttccctttttgtaaatgttcttttaaaacacaccaaattcctgaggaatttgctgttttatctgtttatttttttgatttgttagtgtcctagagcatgaaatcttatttaaaaggcactgttctttcttgatatggatgcccatgattttcattcttactttctaagtccaaaaatgaaatgcagttctgcctcattgggagcatttctgtattcttaaaatgtgctggtgtttttccggctaaagatgtttcagaagcagtgggtaggcaatttgttgtgattcatagtgaatttatttatatggagaattttctccaaattttaaacacagtgtaccctttggtacttcgcgtatgtgccaaagtgtcatctncatatgactggtgcaggccatttgaataaagttccagatgggaatcattggtcaaattattcctttccatcatctaatncaatagcaaatggaagccgttttcnttgcttcccaaaaaaaaaaaaaaaaaaaacccnngnnccnnttnncnnnnacc

SEQ ID NO: 23234 - DNA, 836 bp, Homo sapiens
  misc_feature 2, 4, 10, 14, 18, 21, 22, 33, 44, 46, 47, 688, 724, 742,754, 758, 777, 781, 798, 801, 805, 812, 831: n = A,T,C or G
antntcttgncctncganaanncttgcttgttncttttggccgnannggggtgtattgccttactttccttaaggatattattttgggattacagaaattgattactgctttgttaccttaatgggatgaaagtcattggagaaagtgagtacagctcatgggaggatgcaactttaaggggtttgttcctcctttgtgataagagttttcacagtgcttccgtatacatttctcatctcatccttataatagctctgttattcccattttgcagatgaggaaacagtctcagagaagataagagactttcttagagtcacacagctcatagatgggcagactgtggtcttctgcctcctagttcacaatactacactttctttctgtgatacaagctcacagacatttgtttaaaatgactactggttacagatgctgtggtgatttctggagaaatatcgtcacctcctctattttcagtcagccatcgctcccagccccaacagccttcccagccccagcggaccctgctccagcatgtggctcagtcacagaccgcaacacagacttcggtggtggtgaagtccatcccagcatcttcccctggagcaatcacccacattatgcagcaggcattaagcagtcacactgctttaccaaacacagcgaggaacttgaactgagganggcgaggttaaaaaatggcactttaaacctcaaaangtctgtttaccgatctgnccggctcagacncagnagctaacagcaaaacttancagnccccgtggacaactagntgnaggnaacttgnaagcttcaataaaaaaacnacctc

SEQ ID NO: 23235 - DNA, 895 bp, Homo sapiens
  misc_feature 3, 4, 5, 6, 7, 8, 9, 10, 11, 32, 44, 64, 68, 80, 92, 95,107, 126, 221, 224, 230, 240, 283, 287, 294, 295, 314, 315,325, 336, 339, 370, 379, 386, 428, 468, 469, 477, 491, 496,504, 510, 517, 519, 523, 524, 555, 564, 567, 569, 579: n = A,T,C or G
  misc_feature 589, 601, 616, 618, 629, 692, 771, 804, 807, 844, 846, 865,880, 884, 885, 886, 887, 888, 889, 890, 891, 892, 893, 894: n = A,T,C or G
tannnnnnnnntttttttttccactgtcgctntagaacttcgtntctgtggtcttttttgtggncgcngaacggggctcnggggtgtggcanganaacgaacacaanggggggaccggctcggggntccaaaatacaacggaggggtccgggccgcgctgcgctatggaaggcaggtcaatgcagctgaaaaggaggaaaggccaacaaggaccctgaagngtncggacnacataggatnataacctgtactagagtactaactggaaggatctcatataagnctangaatganntaccaaaatggtaaccggnntgccaggaanccactacaagnatnggtaacgagcaagcatataaaaacaacaganaaggagttncgcgatngaggaaaatggacaaacataaaggggttctcgtatgcacatnaacacgcacgttagaggatgaagcttgcttacatggacgnnaaaaaagntattagatgagganaattncagaaganaagggncaacggnangccnncaataagataccaatgagtacgggaagatgntattacaantangnatggaaacgngacttaaagnagattaaagatnagtttaagaagttgnangagattaaaanaatttgaaggcgatcttttaaaaagagattaaaccgaaggtgattaaaagaccttgaaatacnatgacgcagggatgactacctaccgggagctgatagagcagctacgaaacaagccttctgacctgggcacgaaactacnagatcccccggatcatgaccactctcagcgtanctncttggggtcgatctgggcagtatggatgaggaggaananattgcaacaccttcaccancacccccttccaaanagcnnnnnnnnnnna

SEQ ID NO: 23236 - DNA, 637 bp, Homo sapiens
  misc_feature 53, 56, 69, 70, 99, 136, 145, 149, 176, 191, 212, 217, 218,226, 228, 230, 244, 248, 249, 254, 266, 278, 282, 364, 366,378, 382, 389, 417, 436, 471, 472, 475, 484, 502, 538, 548,561, 578, 579, 593, 596, 600, 614, 619, 621, 623, 626: n = A,T,C or G
aaaaaaaaaaattttttttttttttttttggggccaaacccctttaaaaaccnggntttttaaaaaaannaaaaaaccccttggggtaccctttgttangggttaatttaaacctttttttttttttggggggggnccccccccncggnaaaaaaaaaaccccgggggcccccccntttaaaaaggggggnccctttgggggccccgggggnaaaannaaaaaaancnanaccccaaaaacccnaagnnaaaangggggggggggnaaaaaacctttncccnaattttttttccccaaaaaaaaaaaaaaaaaaacctttttttccccccaaaaaactttttccttttttttccttttcccccnanacttttgggggngggncccaaancccaaaaaaaaaatttttgggggggggncccttttttaaaaaaaaanaaaaaaaaaaaaccccccccggggggggccctttnnaanattttcccncaaatttttttggggggngccccctttttttccaaaaaaaaaagggggttttcnccccaaaagnggggggaaaaacncccccaaaaaccccccnnggggggggggcccnatntttntttaaaaaaaaagnaaaanangnggngaaaaaaaaaa

SEQ ID NO: 23237 - DNA, 842 bp, Homo sapiens
  misc_feature 8, 28, 29, 41, 52, 54, 55, 63, 66, 240, 276, 425, 659, 704,720, 755, 774, 789, 794, 810, 813, 829, 835: n = A,T,C or G
ggggggtnttctcttgacctacgataanncttgtcttgttncttttggccgnannacgacagnaanggttcccattgacctggctgggtgcttccatttgaatggtgtctctgtcttcctactagctagtgagcccttggaggatggacgtttcatcttctcctctttcttctctcttcctccccttctactcttccagcccccagaatttagcatagtgctgtgaatatagtgttgctnaataaagaaatgtcggtaggaattaagttggcattnagggggatggaaagcataaagtgatttggaggtaatcctttctttcatttgttcgatcatattctcgcttagtatgtttcctcctgaaaagtatgactgtggggcaactgttgtatttctgagttctgctttcgcccaccaccaaaaangaaagtctccacttgggaaactgtatattttcaggtcattaagaggttttcccaccttgcccattgtgttccaatggaacttttctgcagggatgggaatgatctttatgtgagctgtccacacaatgcccaaggctgcatgtggccatggagcatttgaaatgggtctagcgcaactgagaagttaagtgggtttgatttcaattaatttaagtagtcatgtgtggctacggnctaccatattggaaaacacaactgtatacatcataaaaatgtcancttggctgtgtgtggnggctcacgcctgaatccaacacttcgaaggctgangcatgtggatcacttgagncaggagttgaggcancctgncacctggggaaacccnctntctaaaaacaaaatancagggnggggcat

SEQ ID NO: 23238 - DNA, 846 bp, Homo sapiens
  misc_feature 2, 3, 4, 5, 7, 9, 24, 35, 46, 48, 55, 66, 69, 76, 78, 88,97, 290, 444, 612, 618, 640, 649, 667, 707, 753, 770, 775,778, 779, 789, 794, 810, 813, 819, 823, 845: n = A,T,C or G
gnnnntntnttgacctgcgtaaancttgtttgttncttttggccgnancggcctnacggctgcganaanagacagnanggggacaaangctcatctnatactaaaagaggggcaaacttatttaaaaatattcaacacggcaggcctcagaggtgctggggagggggagtggaaatctgtttaactgaattaaggccgcgcgcgaagggaagaaggagcgctggggacttgagtacaccagggcccgtccgtgtaagcactggcaacgcaaagcaccttacaaacgcccnaagtctgaagcctgggagtggcggtggaggtgttttcctctgctggcacgccagaatccctggttcagcctggaaggcgaggggcaggactccccagacagtggcctcagtgtgctacacagaagaccgaggcgtgagaattgcttgaacccangaggtggagaggttgcagtgagccgaggtcgcaccgctgcactccagcttggggaacaaagactctggtgtcatctcctgtcagcctttgtttgaaagcacttggaaacttgggtggctgatattctccagaggcagaaaaatgttcccagccgagagaggccatctncagcangtcctgagtgtcaagaattcanattctctgncccactcctgctggatangaggacactttcactaaaacctgggcctggcccctttcanttttctgctggagtcccgattctgggctttgctccaaacatgcccngggcctccggcctggtnatatncanntttttgttangaganacatattggctgtttntanccttcntttncttttttccttggaaaaaaaanc

SEQ ID NO: 23239 - DNA, 277 bp, Homo sapiens
  misc_feature 1, 28, 43, 128, 163, 168, 185, 239, 246, 247, 248, 250, 277: n = A,T,C or G
ngggctttccaacttgggacgctgcagnaatggctcccgcaantaagggtggcgagaagaaaaaggccgttctgccatcaacgaagtggtaacccgagaatacaccatcaacatttcacaagccgccntcccttgggagttgggctttcaaaaaaacgttgcnccctncggggccccttccaaangaagatttcgggaaaatttttgccctttgaaagggaaaatggggaaacttcccnaaaattnnngncccccttttggacccccccggggtttn

SEQ ID NO: 23240 - DNA, 738 bp, Homo sapiens
  misc_feature 7, 11, 12, 23, 34, 36, 43, 53, 56, 64, 70, 71, 80, 86, 104,105, 126, 147, 152, 155, 159, 278, 284, 298, 313, 318, 321,323, 328, 333, 334, 335, 341, 345, 351, 357, 358, 359, 371,380, 382, 383, 390, 402, 406, 409, 413, 420, 423, 434: n = A,T,C or G
  misc_feature 447, 449, 546, 548, 550, 586, 597, 598, 620, 625, 630, 632,635, 648, 652, 672, 676, 700, 703, 707, 714, 721, 725, 727: n = A,T,C or G
cctgcgntaanncttgcttgttncttttggccgnancggcctncgggtgcganagnacgacagnaggggnnctttccctncggtgngccactgtaatatcctgnncgtaggcggatgggccgagcnttgaggcccgttgttaccggngttgnaanaacnggccgatcccaaagaatacaactacttaaaaaatatagtcaataggttactaaggtattgcttagcgttaagtttttaacgtaattttaatagcttaagattttaagagaaaatatcanatgacngggagcagctgtcntatgaagccctggangctgncgntncttgngccannncgtacntggnaaaagntgtggnnngagatggcgtcncaggtactngnngtggctnaccaacattcancggnaantgcncttccgncangacccagttcngtgggcaattagnanggccactgccttttagatttaagaatgaaggtgacgttaaaacagccttaaaagtttaattttaaaagtttgtaagggggattaaaaataatttggnangncgatccttttaaaaaaaaaaattaaaccccaaaggngattaaaaaanncccttgaaatcccttgaccccnggggngtgtngntcntttagaacccctntttnccccctttggcctacccccngccnaaaatgggaaaaatttatttgggnggngggnagggaanaaacccntttngnaaaaaaaaaaa

SEQ ID NO: 23241 - DNA, 779 bp, Homo sapiens
  misc_feature 2, 9, 11, 130, 661, 673, 692, 707, 708, 724, 731, 749, 755,761, 767, 770, 772, 776: n = A,T,C or G
gnagacagnanggtaaaggcattttcttaccttcctcttctcatagtctgagaacctgttctgggaggaaaaaaagacagtggtcaagagagggtggcagcagtggttctccctggcatgggcaccaggnaacccccgggtggcctgatgttatacaaactctggcccaccccagaccactgcctcagaatggtggggtcgggggatgaggggatccgtattgatcaagggcaccaggtggttccagtggacacctgatgagaacccctgggctgtcactgtgtgcatggcactgtaggaggggctcttcaagacagttctgggatgcagccctgagcagggatggtggtctgaagagcagagcaggaaatgggatatctgatgcccatggatgtctgcgtaacacacctacagcacccggttccagtccaccaaaatactcacagtgcacaaaggtgtgggtacaacttcctgcagaattattcaaaagagcaaaaacactggaaataactcatacatctatcaacatctgtccgtaagtcatggtgcatccatacagtggactattacacaaccgccaatggggcgaatgtgtgagatccctcacctgtgtgtagcatgattctacttttgcaaaacttatcaagaaactcactctganctatgtgtgaangtattgagtcaaagtcaanaagacagtcttaatnnttatgatgactacctncagcacnggaggcagggggaagggngacttncttggntgaatngcngnttgntaa

SEQ ID NO: 23242 - DNA, 803 bp, Homo sapiens
  misc_feature 1, 12, 19, 22, 30, 691, 704, 768, 774, 775, 776, 780, 783,784, 785, 790, 791, 793, 798, 799: n = A,T,C or G
ncggcctacggntgcgagnagnacgacagnaggggaactacctacctaagcgatgaaatccaaaggtgaatcttttggttggtgattttgatgatagccacaaagcaagcaggctgtatggtagccttgaaaaccaacaggccacaatcacagtgaaaacctcaggttggcagccactggaggatacaaaatgagtttggatctccttcaatgccccattcccagagaactgtcattatttgacctgctggtagttccctaaaggacgtgcaaggatgtttttatttgactggacacttgaagcttgccctgtatgaacagcccccatcttcccatgcttgtcaaaaatcagaggcaactaacactgcggcttcctgagagtctcactctgtcacccaggctggagagcaattgcacaaacacttggctcactgcagcctcaacttcttgtcctcaagtgatcctcccaccttagcctcctaagtagctgggaccacagtggagacggggtttcaccatgttggccagtctgctttcctcctaacctcaagtgagccgcctgcctcgaagatgctttatttataagcgctttggacacactttaataaatgctctattgtatacagttgaactctatataacattttgaataatatggtaatgcttaccctaagactactatcatctctgnattggtaacaaanatttcccatttgacaataaagtcagttttgaaaggaaaaaaaaaaaaaaaaaaaccctggggcntttttnnnaacnaannnaaaanntngaggnngaac

SEQ ID NO: 23243 - DNA, 699 bp, Homo sapiens
  misc_feature 162, 163, 398, 531, 557, 577, 609, 625, 646, 657, 686, 690: n = A,T,C or G
cttattaagccatccatctacccatcctgctcacgtatgtgtcagacttttagtgcccactgcgtgtgtggctctgcactgtgttcttggggtctaacataatgtaggcaatctgaaggttactgtccagtgtgggaagcaaaaggaaatcacggtataagnngtgctttctttaatagcagaaggggctacatcctactgtgggaatgcagaaaagggagtgataagctgccttcatagactgtgctttcattttttgcaaaagtaaatgtaatcaatatgaatttgtggaaagtgtagcatatattgccatgtgttatgactttgagcttattttaaaataaagatggatgcctgtttctgcctaacatgttagtcagtgttatcaaagacaagangcagaccattcattcactcatttccaaaacactgaatgccattctgtgcctagcgctatacaagacatcggaaattcagtgtcaataagtctttgcttttcaatcaacagggacgattttaattatagattgncttcctattaagatgaatttagcagnattaaaattagtttgatatntgagaaaaaatgaaaattgaggccggggcagnggctcatgcctgtatnccaaactttggaggctgaggnggaggcttganctaagaatttgaaccacctggcatctaangganctctttttc

SEQ ID NO: 23244 - DNA, 728 bp, Homo sapiens
  misc_feature 170, 172, 174, 476, 547, 552, 564, 587, 588, 592, 613, 614,616, 634, 651, 676, 693, 702, 705, 710, 712, 713, 717, 723,726: n = A,T,C or G
gggagacatggaagaccaaggacatggcccttcctctgcactgtattgaaagcatctttccagagaacatcaagattggtgagattctggcactgtcttgcttctagtgccctggctggtgctcagcgagatctttcctggtgggatcagaggacgagccatggctttancngntagcatgaactggggcatcaatctcctcatctcgctgacatttttgactgtaactgatcttattggcctgccatgggtgtgctttatatatacaatcatgagtctagcatccctgctttttgttgttatgtttatacctgagacaaagggatgctctttggaacaaatatcaatggagctagcaaaagtgaactatgtgaaaaacaacatttgttttatgagtcatcaccaagaagaattagtgccaaaacagcctcaaaaaagaaaaccccaggagcagctcttggagtgtaacaagctgngtggtaggggccaatccaggcagctttctccagagacctaatggcctcaacaccttctgaacgtggatagngccanaacacttaaganggtgtctttggaccaatgcatanntgcnactcctgtgctctcttttcanngnatggaactggtttgaaanacctctgaatgataaanacgcctttatcccctcctcccaaangaacctcaaaggggatnaggacaagnccnaagancnntttntgagcngantt

SEQ ID NO: 23245 - DNA, 745 bp, Homo sapiens
  misc_feature 6, 13, 18, 19, 22, 38, 177, 178, 619, 670, 678: n = A,T,C or G
gggagnagcaagnacctnngtnaatatttgttgaatangaagaaaaatgaacaagtgcatgaatgcgtgaatgatgtagaagacaatccagtaataccaaagaatctattggaatcaaaattattaaaaagaaaatgcagatgaatggagaatttatgttaaaagccaaaagagtgnngagctttgacttttaggcatcatcaaatttaataaagagatatcagtaacatactaaagcaaaagccagatggttttgaacttaagaataaatatgatgtaaggaaatgaacacagcccataaagccaacctttcaaaaagagtaacaataaagggagaatggtagtgctagagaggaatgatgggatgaaggagtctgagatttgtttgtctctttttaactttgtggcagagagaattggacatgctcaccaatttttctactactttgtcctgctttcctgatataccacagggaaagttctataaacatttcctactacaaagtgaaaagaaacctattttaaaagactgggttatgggattttatgtaatatttttcaatttttgagtaaggaaaactttctaagttttcagtctacctgaaattaagcctttttncttatttatgaaaatagttgtacaatttgtcctgaagtatccaactttatncttactanggcaatttgcttttaagtttctcctccttttggctctcttaaatctggattttcaggttaatctaag

SEQ ID NO: 23246 - DNA, 567 bp, Homo sapiens
  misc_feature 153, 175, 183, 194, 201, 241, 268, 286, 328, 341, 400, 413,441, 451, 456, 462, 471, 474, 477, 489, 511, 516, 521, 537,540, 552, 553, 554, 560, 563: n = A,T,C or G
aggggagaacgatggcctttctgcggtgtctgcgaccgggaccaaggcggagcaaagtcgccgggggtgtggggtgttccacgctatgttgggagtgttcgctttcgaggtacatgactacgttctaaattttttttttttgaaacagtttcnttcttgttgcccaggcttgagngcaatggngcagtctccgntcacagnaacctccgccgcccgggttcaggcaattgtcccgtctcancctcccaagtagctggaattacaggcntgccccaccacccccggnttatttcgtatttttagtaaaaacgggtttccgcatgttggncaggctggtctgnaactcctgacctcaagtgatccacctggctcagcttaccgaagtgctgaaattccgggngtgagccaccgcncctagccctctaaacttttaaataatcngaaatgtatncccanctgaancaaattcanctnttncctctacctttnggggggaatttaaaatactgancttgngaaanaacctgggggccccanttncaaacttttggnnnaggacnctngcct

SEQ ID NO: 23247 - DNA, 696 bp, Homo sapiens
  misc_feature 561, 579, 631, 642, 650, 658, 669, 687, 693, 694, 696: n = A,T,C or G
ggggcgcccagccggggcactcttacgtatcactggtgggaatacaaaatagtacaactcatatagaggggcattatcttttgacccagcaatctcacttccaggaattttttaccatgaatatacatttccaataatacaaaagtacacacatccaaggttatatataatattagatgtaattgcaaaatactacttagatgtccaagtataagcaattatttgaataataacatatccacacaatgaagtattatgcaactataaaaaacagaatgaggacaacctctaccaactaatacagtatttccaggagatactattaagtgaggggaaaaaagtacaatcctggtgctgattgaagaatttttttaaaagtacaaaagaacacatatatatagtatgctatctttcctataagaaattagaggccaggcacggtgacttgtgcctgtaatcccagtactttgggaggccaaggcgggtggatcacctgagatcaggagttcaagaccagcctggccaacatggtgaaatcccgtatacaaaaattagccaggngtggtggcagacacctgnaattccagctactcaggaggctgaggcaggacatcacctgaatccaggaggnggagactgcantagctganatcgtggnctgccctctancctgagtgacagagcaanctctgnntn

SEQ ID NO: 23248 - DNA, 530 bp, Homo sapiens
  misc_feature 13, 35, 142, 176, 178, 225, 277, 289, 303, 327, 336, 342,365, 390, 396, 444, 458, 474, 477, 480, 490, 492, 494, 500,506, 508, 509, 510, 518, 521, 529: n = A,T,C or G
ttttaattatggntagctgtctcaaagcataaaanggaataacatatcaaatgaaacagggaaaatgaagctgacaatttatggaagccagggcttgtcacagtctctactgttattatgcattacctgggaatttatatangcccttaataataatgccaatgaacatctcatgngngctcacaatgttctggcactattataagtgcttcacaggttttatgngttcttcgtaactttatggagtaggtaccatttgggtctctttattataagngagagagatgangtttatattatcanggggactaaagtcacacggcttgngggcactgngccaanatttaaaattaaatttgatgggngaatacagttacttaatgaccatgntatatngcttcctgggaacatctgccatttatttcctcagctggacaaatcctntggtttctctctgnacacactaacatcaanggnttngacttggganananaaaccntgcccnannnggggcacnatncaaaaaanc

SEQ ID NO: 23249 - DNA, 316 bp, Homo sapiens
  misc_feature 1, 2, 178, 193, 222, 248, 251, 263, 270, 301, 310: n = A,T,C or G
nnggtgttttaaaactgcatgggaatattaacaaaaaataacctaataatattcttcgaggcttaaactttggttatagtctatgtcctagcctagcttttatgataagcctgttgcattttaaaaggtgcttattggattcacatgtctttcagtaaaaaatcttttgaggaacccngacttttggaaaagnctattttaattttgcctggtatttggggncctttacaggggctaaaacctggaanaanaaagttttgggnaaaattngggttcttttttaaaaaaaaaccccctgggntttttgggncccccc

SEQ ID NO: 23250 - DNA, 673 bp, Homo sapiens
  misc_feature 13, 17, 20, 171, 176, 196, 206, 282, 339, 419, 443, 493,500, 534, 535, 569, 578, 594, 595, 596, 611, 616, 619, 620,624, 626, 629, 634, 638, 649, 672: n = A,T,C or G
gggagaatatggngggngantgccttcagctgtccaggcacaaataaaaaataatgcatctcttcagggattgtccctctggagagccccccacccccaagcattgaaacacttgctctaatgttcccatagcatgggtactattttcagctatcaagaaagaatataatntgggngaaaaaaaaaaatcttgcanactatattgngtgtagtcccttttctcctaaggaacaaaaccataggaagaaaaaattgttgattagtgatgataccaccaagtanaaattggcaagatctaggaattggaattatatgttagtaaccttaaaaatagaccanactcttttattcagtaattccacatcctgaaactcatcccaggaaataataatagatatgtttaaggatgtaaacataanaaaatttattataacatactgttntaagatataatacaaaattcattatgaagaatgatcaagttaatgatggnggttccnaataatagattaccaggcactatcaaaatgatgnntttgaaaagggttaatgacataggaaacctctgngttcaaagncaggaaaacatttgannnatcccattataatanaaaangcnngccngngcnggggntcancctggatcccnccctttgggaggccaagggggcna

SEQ ID NO: 23251 - DNA, 504 bp, Homo sapiens
  misc_feature 1, 49, 54, 232, 237, 249, 270, 276, 305, 308, 363, 369, 375,376, 385, 389, 403, 428, 430, 437, 442, 451, 460, 461, 485,492, 495, 503: n = A,T,C or G
nacgatagaagagactttggtcgtgggcgcgtgtgtggaatgggaaggnaggtnccgcgctgtccatgggcgtccttggcctgcgccacccagagatgataaatagccaaagacgtcaatggcacccatgggcccattagttaagccttagtaggagctgaaaaactagaagcaatgaccatgtcaactattttgagcaaaaaaaagcagtgtctttcggaacatttgatcntaaanccgaaatttaangggtgaaaaaaacattttttnttgaancttttacctttcccattttcctaaaaaanacntttttttttttggaattgggggggggggggtaaaaccctccaacaaaaaggtttntttttnaaaaannaaaaaaacncccnccccggggtggggnggaaaaaaaaaggggggggcccccncntgggggnccccntttttttgngggggccgnngggaaccctttccccaaaaaatgnccctttnttntttttttng

SEQ ID NO: 23252 - DNA, 97 bp, Homo sapiens
  misc_feature 55, 60, 61, 65, 66, 67, 68, 69, 73, 74, 75, 77, 79, 81, 89,91, 93, 94: n = A,T,C or G
acacacacaggtctaagcctagtatgtcaataaagcaaatacttactaaaaaaanaaaannaaannnnnaaannnananangggggggngnannaaa

SEQ ID NO: 23253 - DNA, 711 bp, Homo sapiens
  misc_feature 8, 34, 507, 547, 551, 570, 581, 599, 609, 621, 630, 632,636, 637, 652, 674, 677, 703, 705, 709: n = A,T,C or G
gggccagnactttgttacacacttctgcactagnagtttgagcttagaaaaccctgcctgctccatgctagcttcaaggacttcttgggcagaggtgactatggtaaggcaaaattggggcatgtggctttggtcaaatgtcagaatgccatcttaattgccctacagcgcataaaatctcaacagaattgctatttcagttttacaaatgaggtaactcaacagtagggagtttaaataatttgcccaagctcatagagggctaatacgtagcagaagctgacttggaacccagggtcacctaattccagagttttactcttaacaaccatcttacactaaaacagtttttaagaataaagtagcaatccagaccatgtacaaacaccaagtgaatggggtggtggactgtgctagcagaattgagatgaagtagctattgcagtggaccatgagtcttcataaggatctcctgatccataatgaagcacaaatactgaaaagcanggactttagcaggacacagaaacaggaaagggaagtccanccanttcatatggctgctttcantgggctgttgnacctgatcattatgtggngtccaggaanatgcccatgaanaacctgaanangccnnaactcggatctaccnccactctgctttgggacccccnttntggttcctcttatgacccccccggcntnactntt

SEQ ID NO: 23254 - DNA, 719 bp, Homo sapiens
  misc_feature 439, 505, 529, 587, 605, 611, 624, 626, 647, 662, 687, 714,717: n = A,T,C or G
gggatggaagttgtggccttcagaattgacacttactgagagactagaacagcgtgggtgagttgtgaggggcaggaagcatgtcttaatggacttaaccaattttcgtcaactattcacagtaaaatctttcaatatacaaaatttagtaatctgataaacaataaacaaaatatttgaataggcatttttcataagacgtacaaagggcagacaggcatacgaaaaggtgctcaacatttttgatcatcagacaaatgcaaatcaaaactacaatgagatattatgtgactcagttaaatggcttatatccaaaaggtaggcagtaacaaatgctggagagaagtggagaaggggagcccttgtatgctgttgacaggaatgtaacattttgaaaattcttcaaaacaactaaaaataaagctaccatataattcangaatgccactcctgaggattcacttactagaaaggaaatccatacattgaagagatatctaccctnccatgtttgtacagcagtgtgctncagccaatatttggaagtacctgtgtcctcaagaaatgactggataagaaacatggcnctataccaatggatactnttagcntaaaatagatctntntttcacacattgtggacctanattaatgaataaccngccagaaacactttctgtctccttntttgcggactaaatcaacattactctntgngg

SEQ ID NO: 23255 - DNA, 725 bp, Homo sapiens
  misc_feature 551, 560, 580, 584, 591, 610, 622, 642, 646, 656, 659, 663,669, 676, 697, 703, 707, 713, 715, 720: n = A,T,C or G
gggtcacccagactgaagtgcagtaactcactgcaccctcaaactcctgaggcttaagggatcctcctgcctcagtctcccaagtagctgggactacaggtgtgggactacatgcccatgcccacgtatttcctattttcagtgtaattgtaatgattccagcagtagcctttaacgatgaccccccatgcaatttatggtattcaaaatggataccaagatctttgcaggtggttaattggagatagggtcctagataaatggcagatcactgaagccctacttgatctgtatagccaaaaatttctccaggtttggaggcagatatcaagacagaaatgcagctctggattctcttgctagacttaagctagtttacagattcagagcctattcaataatggagaggccatgtatcctgaggaaggagcttgtaaaagtgctgccagtacagaatgtgtatcattaccattttatggataaatgtgtattaccattttgtctggataactgtacactagggaaactacacaaacacttgggccacaagnggatactanctggtagttattactaattnccanatacccncaatgtcattggccacttntaaagttatatngggaccaggaatgatggagnttgntttgtttatnccnctgnttgttngtttganacgagctcccccatcccccanctaaangcanggggcntnttggntactg

SEQ ID NO: 23256 - DNA, 735 bp, Homo sapiens
  misc_feature 1, 9, 618, 632, 634, 653, 670, 671, 677, 685, 718: n = A,T,C or G
nacgacagnagggtccctaattcacagaattatttggagattaaaataagataatgaatcagaaaataccttataaactgcaatacaattgaatagtcctaatagtaatgggagagctatttggaagctatgtactgaaaaactgattctatggcagacatgagtgttttcctcatttcttcattgccctttatttctgttttcagaacacttgaaaaatttcagaaacgtaaaaagcttaaaatgtacattagcatgatgtatacttcacaaaaaagcgaaaattatgggataatctgacagaaaagacaagagaagactgaattatgaaaaccaagattgtcctgtgttggtatttcacattagttgctatattttacccatatttagtcagtgaatatgtttattgtactacatctgggagagcttatctagtactatacttagaagttcctattgcctcaaggtaattttcatatgacagagaaacagagaaataaggcaaaagctggagggaatgtgggggattttaaaaagggcaataaagaggagaggtatacagcattattatttactattagtaatgaaccattagtcagggcaaatgatccaaatatnaagagaaacttacntnttcacacacacacacacanacacgcgcacacacacnntatacncaattttnatggcggcttattcatatatccccaactaaacnacctaaaggctttcatg

SEQ ID NO: 23257 - DNA, 738 bp, Homo sapiens
  misc_feature 7, 14, 31, 33, 53, 54, 64, 73, 76, 81, 85, 215, 221, 300,456, 488, 585, 596, 617, 619, 623, 652, 653, 654, 667, 671,673, 685, 690, 694, 706, 714, 718, 728, 731: n = A,T,C or G
tccctanttcacanaaattatttggagattnanataggataatgaatcagaanntaccttatanactgcaatncanttgantagncctaatagtaatgggagagctatttggaagctatgtactgaaaaactgattctatggcagacatgagtgttttcctcatttcttcattgccctttatttctgttttcagaacacttgaaaaatttcaganacgtanaaagcttaaaatgtacattagcatgatgtatacttcacaaaaaagcgaaaattatgggataatctgacagaaaagacangagaagactgaattatgaaaaccaagattgtcctgtgttggtatttcacattagttgctatattttacccatatttagtcagtgaatatgtttattgtactacatctgggagagcttatctagtactatacttagaagttcctattgcctcaaggnaattttcatatgacagagaaccagagaaatanggccaaagctggaggaatgtggggattttaaaaagggcactaaagaggagaggtaatacagcattattatttactattagtaatgaacccttagtcnggccaatgatncaaatataaagagaaacttcntnttcnccacacacacacacacacgcgcccacacnnntaacacaaaattnttgngncttattcttatntcccnactnaacacctaatgnttcatgantaanggtaaacagngtnctctgtt

SEQ ID NO: 23258 - DNA, 717 bp, Homo sapiens
  misc_feature 578, 620, 634, 655: n = A,T,C or G
ggggaaatgaggacttaacctgctaaagctagcacaggtattaccagcaaggataaagaatgataagttatagatgtgatgaagtcaagtctcaaggcatagtagtggttttatacacaataggcacatgaggaagaagaaaaggaagtgctgttattgaggaatgaggtatttggcaagactttaaaaacactgtaaggattggaactcactcttgtagtttttacagttttaacattaaaacagtacctctggtatattttgaattgaccatatcacccagtgtgttaccttcaatatcctctctcttggattacagctttttgaaaggagcttggtactattggtggtgccactattatcaaaatcagtagcacggtctttagattgttaaagtacatacctaaatccttctaagtctttcagctgtatcataaattgctagcctgaagatgaaaaaaggacaaagttaaggatggttgtctgaaagcattgcagctttcctaaccatgggttaaaaagcaggtaaattaaattgctgtgtatatatctcatttgctattattttcaaaagtagntatagatactccttttaaactggaaagaagaagcttttttanagtctacctttcantccctggactttcctattggntagtgaagttttacttactaaagacagtgatgggaaactttataggagattggaattaaatc

SEQ ID NO: 23259 - DNA, 175 bp, Homo sapiens
  misc_feature 111, 118, 123, 124, 126, 128, 132, 141, 146, 151, 152, 157,163, 167, 168, 170, 171, 174: n = A,T,C or G
ggggggttcttacgcgcgcagacagaccgcctatataagccatgcgcaggcggaggagcgcctctttcccttcggtgtgccactgaagatcctggtgtcgccatgggccgncgacccncccgnngntnccgntattgtatnaacantccanncccanagtctnactnngnnccna

SEQ ID NO: 23260 - DNA, 569 bp, Homo sapiens
  misc_feature 8, 25, 257, 260, 262, 266, 270, 272, 273, 275, 281, 282,288, 292, 298, 303, 306, 310, 318, 321, 322, 325, 346, 347,353, 358, 359, 366, 369, 370, 375, 400, 403, 419, 431, 439,448, 454, 459, 466, 476, 477, 481, 484, 491, 513, 520: n = A,T,C or G
  misc_feature 524, 527, 541, 561, 567: n = A,T,C or G
acgacagnagggatacaaactgagnactttgataattatctgtcaattgtaacttaaacatagtgataggtatttcctggcttcatgagagaaaacagaaggaatagaatagatttcagcccttggaattaactcatattaaacgataactataaggaatgtgaagccataatatggaaaattatatgtgtgtgtgaatataaagaccaggtgtgtgtgtgtgtgtgtgtgtgtgtgtgtgtgtgtgtgtgtgtgtntgnanacancaangnncncttttnnttaatntctngggggnggganaanaaantgtttttnttnnaanagttttctacagggctacagnnaccaanacaanntgggtcnggnnccaanacatatatacacacctgtggcacanagngggcgcctcaaaaaanatgccacacatntaaaaccntcttttttntgacanacctnacaaaancgcgctgtgnngagngcnttttttnttttataaagggggcggggaanactgctncccnttncaaaaaaaaaaacnggtcccttttttaacccttnacaaanat

SEQ ID NO: 23261 - DNA, 725 bp, Homo sapiens
  misc_feature 5, 555, 567, 572, 603, 607, 614, 621, 635, 680, 691, 701,708, 711: n = A,T,C or G
agggnagttcttccaggggcagatatggctgcatttatttcatagatggagaaactgagcacagagctgtaatgaagacagaattgagatataagggcaaaagctaattaaacgcatcctcacaggtagcctttctttcagtgaacctgtagactagtccagtaatacttattaaaattagttgttagaggctgggcatggtggttcaagcctgtaatctcagcactgtgggaggccaaggcggacagatcactcaaagtcagaagttcgagaccagcttggccaacatggcaaaaccctgtctctactaaaaatacaaaaattagttgggtgtggtggcacatgcctgtaatcccagccactcgggaggtgaaggcacaagaattggttgaacctgggaagcagaggttgcagtgagctgagattgcactgctgcactccagcataggcgtcagaataagactctgtcttggaaagaagaaaaaaattgttagcctaaaaccaactctctctaaatttaaaagagtgattatttatcttagtattatagaagtntgagattatcanaaggngcgatgcacaatgctcattattttatcctanacanacccgtntaacatntacagtaaagaaanggaatctttcttaaaaaaattctgtattaatagtgactgactcanactttgagggnaaatgaactnttagcanaanttcccatccctcat

SEQ ID NO: 23262 - DNA, 436 bp, Homo sapiens
  misc_feature 4, 13, 14, 17, 23, 25, 27, 28, 31, 36, 38, 51, 64, 65, 71,111, 117, 129, 314, 319, 332, 337, 338, 352, 358, 367, 370,373, 382, 399, 405, 413, 416, 429, 433, 435: n = A,T,C or G
ccgnaacggcctnnggnctgcgnanannagnacagnanggggagagccaangcagggatcaaannaacatnctttgcgttttctaccggctccccatcatcgtactagggnaggaanaagcgggtgagnaaacaaaacttctttaccattgtgcctgcccgtttctgcggacttgttctgaggccgaggcacctctaagatactgatggctctgcagaggaccccattcattgcttctgcttttgctgctggacccctgctgggggctgggggcttggtcccaacccccttcctatgggcccagggatgggcantgttnccaaccgaaattnccctnngggggggaaaaccnccgggnggccccccnttngangggaaaaanaaggggggggggggggnggaaanccccttanacnggggaaaactttngggngna

SEQ ID NO: 23263 - DNA, 779 bp, Homo sapiens
  misc_feature 14, 582, 609, 618, 624, 633, 652, 672, 682, 685, 693, 717,727, 728, 745, 750, 752, 753, 777: n = A,T,C or G
ggggggggatccgntgcgcgccgctgccgctgcgtgggggtgagggcatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcggcatttgcccccagcacagcaaacgtttcctgagagctctaaccaaagacaaacttttggaagccaaacactcaggaccaagactatgtatcgatttgagtatgacccactacatgtcaaagaaggaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttnccttggaaacccttgtgtacctgactnctgactcanaacacnctcttgaanatgttgatctaaacaaagnttacttcctcgggggcttgnggatgaagcnttnaaaaaagngacatttcaaaggcccggatactntgtcaaaccnncccttgccatccggatnctggncnnaaccaaatggaaaacttcttccanac

SEQ ID NO: 23264 - DNA, 513 bp, Homo sapiens
  misc_feature 28, 73, 181, 346, 393, 396, 398, 402, 440, 446, 452, 470,482, 487, 488, 492, 498, 503: n = A,T,C or G
ggggaagcgaccctcccaccttggcctnccaaactactgggattacaggaatgagccaccatacttggcgtanagctgttgttttttggtctaggccttggtgggagaagctgagagaggcagctgaggggctttcttttaaaactgatcactccctgtggcccttttaagtttgggggtnactttcttgtccctgcccccataacatggattttgcctctacttgtctattttacctaaaatcctcatatatctcaagtctggcctcagagcaaacagcctcgccagaatctccaaagcctcgggtggaaatatttattatgacggctatgctttagcaccctgnctcggggcctttgcacgggcttttcctctgctggaggcactttttcnggncnttcntgggtcctccctaacttgccttaaggttggtaaacttncctctnaggaancctctgtcccctttttgnccccccttcttnttttnnttgntacccnaaagnctttcttggg

SEQ ID NO: 23265 - DNA, 780 bp, Homo sapiens
  misc_feature 1, 4, 565, 627, 695, 709, 714, 726, 736, 737, 738, 747, 753,760, 763, 768: n = A,T,C or G
nggnaattagcataagggaaggagagaatttatgaactcttataactggaaatctgaagttggaactggacttatctttattgctttgaatttaagagggagatctttcttctacccaaatttgcctaatattggggaagaaactgattgtgtctgtttgggatgccggattctaaatcagtgacagtgggcgggaaactgtaggcatttatgtactggaaaatgaggagtccttttctgtgtaatttgaccaactaacagaaaagtcttaaattcactaacgttggggtctcctccctggatgacccggcagatctctatacataacaacctccactgtgtgctcagagataccagtcagcctttgttttgtcttgtttgagacagtctcgctctgtcgcccaggctgtagcgcagtggcgcaatcttggctcactgcaacctccatctcctgggttcaagcgattctcccttgagaatcctgtaattccagcctccctagtagctggaattacaggtgcccaccaccacacctggttaatttttgtacttttagtagaggcanggtttcaccatgttggccaggctggtctcgaactcctaacttcagctgatcctcctgcctancctcccaaagtgctgggattacacgtgtgagccacctcacctggccagtcagcctttaatttctactntgcacatagcaacntttcnaatactagactnctagggagcnnntttaaagtnaccccnactaccnaanaactncgcttgaggaaa

SEQ ID NO: 23266 - DNA, 748 bp, Homo sapiens
  misc_feature 1, 12, 16, 18, 42, 67, 174, 175, 176, 177, 433, 609, 611,636, 639, 641, 642, 649, 662, 675, 687, 690, 711, 714, 716,719, 723, 730, 734: n = A,T,C or G
nggtgtttcagnaaangngtcctcattgccatccccacaagnattttaattccacacatatactgtntatctctttatgtactatatgtatatctgtactttgtacataaaaaggctaagtatagagcttactgtttttattcaatacaggctcaagaagagccgaataaagcnnnnaagctgaaaattaaattaaaaattaaagacctattaataccaaatttagctttgcacctatacttgctgaataacttttcatgtaatttatttacttatatatatatatatatatatcatcacaatgtgtcaatttacatacataaattagcaattcataaaaaacaacagcaatataataaattcttataaaatcatttaaaacttatttttttcagaaaaaaattttaaaaacttctttaaaaatattcttagngaacttttaaaactttttgctagatatgagaaaacaatttttaatttaaccagctaatagatgtacattcagatattgacattttttcctttcagcgcttgatataattaatgatggggaaacacttttatgtaattaaatatatactactttcattaatttcaagctcaaatctncngaaagcagaggtcatttaagcttcncangnngccatancagccaaaacccnaccccctttgctnttgacctggganaanatcaccaaggccccactgggnatntnttnccanttggggncagnctgcacactggggt

SEQ ID NO: 23267 - DNA, 510 bp, Homo sapiens
  misc_feature 10, 12, 15, 19, 20, 32, 40, 44, 53, 63, 65, 67, 68, 75, 77,103, 106, 222, 241, 247, 254, 260, 286, 314, 315, 334, 336,337, 338, 358, 397, 398, 400, 401, 402, 408, 438, 441, 444,476, 477, 478, 486, 487, 489, 496, 507, 508: n = A,T,C or G
tttttgaccntncgntaanncttgtcttgttncttttggnccgnaacggcctnacggctgcgnanannagacagnanggggttttgcaggacgccaccgccgnagnaaaaccgtgtactattagccatggtcaaccccaccgtgttcttcgacatttgccgtccgacggcgagcccttgggccgcgtctcctttgtgctgtttgcagacaaggtcccaaaanacagcaaaaaaattttcgnggcttntgaaccnctgggnaaaaaaaaaggattttgggtttaaanggggttccctgcttttcccaaaaaattnntttcccaggggtttttttntnnntccaaggggggggggggacnttttcccccccccccttaaatggggcccttggggggggnnannntccccntttttttgggggggggaaaaaattttttanaanaanaaaaaaaatttttttttttttaaaaaaaaaannngggggggnncnggggggnttttttttttnnct

SEQ ID NO: 23268 - DNA, 843 bp, Homo sapiens
  misc_feature 9, 10, 11, 12, 35, 36, 48, 59, 85, 759, 768, 808, 812, 823,831, 832, 836: n = A,T,C or G
gttttttannnnraataacttgacctaacgataannctcgtcttgttncttttggccgnacggcctcggctgcgatatcgacagnagggggtactcttgtggcaaaactgctggcaagtgtaccctttctgcagaaagtaaaaatggccttgctgaggaaattaaatttatgttcaagtgctatcctttacagcaccagggaacaagcatttctaacaatagcttatatttactacttaatgtttgatttacttttattgcaaataaggtcaaatcaaacatttacaaactggtacaataatacttttttgtaattagatatacaccaattcatactgacaatataacaaataattgtaatattcagttctagtattctactcaccacaaatccaacatttatttttccttctctattcttcctgctgaaaatgttaatctcttcagacaattatttgctatgaattcaaataactgctccaatctaataattgttcatataattcatcttaaatgatacaggtgaaataattttctcttatggctgacataagacagtctttaattacaaaaacaattaccataaaaaattgtggccattatttccataactatctttctttctcctcccttccacttctgggacttcarttgcaggkttgttaractgcctgatgttgyctcaccagtcattgaggctctgttattttgctttcagcacttttctctctgggcttattctggagttctgtgcttgantaaattaangggcttctttttgyagactggccttctaatwctttatccntcangaaattcattnagctggcnngganctcacct

SEQ ID NO: 23269 - DNA, 1080 bp, Homo sapiens
  misc_feature 1, 9, 908, 942, 949, 955, 1002, 1029, 1032: n = A,T,C or G
nacgacagnagggggatatgtatatatattgtgcttcctctgcctgtcttacagcaatttgccttgcagagttctaggaaaaaggtggcatgtgtttttactttcaaatatttaaatttccatcattctaacaaaatcaatttttcagagtaatgattctcactgtggagtcatttgattattaagacccgttggcataagattacatcctctgactataaaaatcctggaagaagacctaggaaatattcrtmtskwcmytrcrmtwsscmmtkratttrtkgstawyyrswsmkccmckkccwrysrctakcsatgagtctyykaywkcmrrrtacatgaaatcatatgaawcygcragtggatawttggagygctttgaggcctrtggtggaaaaggraatatcttcacrtaaaaactagacagaagcattctgagaaacttckttgtgatgtgtgcattcatctcacagagttgaacctttcttttgattgagaagttttgaaacactctttttgcagaaaccgcgagtggatatttggagcgctttgaggcctgtggtggaaaagggaatatcttcacataaaaactagacagaagcattctgagaaacttctttgtgatgtgtgcattcatctcacagarttraammtttyttttgattgagcagtttkgaaacystctttttgtagamtctgcargkggatatttggaaccctttgaggcctatgctgaaaaaagaaatatcttcactacatgatgaccaccagcagcacctggggaaaccagcaccctgtggaattccatacggtgcatagaatacatcctcccttcagtcggcttgggtcaacttaagtcatgggccacctggctgatagcagtttccacagaaatgcttcaagatggnataataatccaaatctctttgcatggggcatggngtggctntctganaaaacctggctttataggaaggagaagaaaatgcttcttgagggaanaaccacaggatgtgcctaggaatgtcncanagagaggagctggatgacttttgcaatatttcttgggtcttggtcctg

SEQ ID NO: 23270 - DNA, 797 bp, Homo sapiens
  misc_feature 763, 766, 771, 772, 776, 777, 778, 779, 783, 786, 787, 793,794, 795: n = A,T,C or G
gggaacatcaattaaaaaaacatattattgaaactgtacattakgrtctggaatagaacaagraagatctatgtagcacaaagaaaaagttaattggaaactatgattaatggagaagtctatggggtcacgtggaaactgtttaccttgccacctctctgtagtcattaaaactcttgaaaatgaattttcttatcctaagagtgtaaaactgatgttgtggagcattttgcacatgccagacacagatgaattcaagacgcagtccctacactccgggtttctacagtttagctggacagagatgaacaaaattgcaatggagtgtgtaaggggccatagtgtgcaaggcccaacacctccctgagcgaaggacgtcagcactggttggctggatcctggccaagcttgctgtggggaagtggtcgatgtagtgtggggaaggccatttgcactgatggcccctgtggagcggaacattctcatggctgtgtctgttacccaaataactagaggatgctctgtgtgcaaatcttgttttctttaatcagcataaaatctggaatgaggagaaatagcttctgaaatgcgctttctcaaagaaggatgagcagaatgagccacaccatctataccaggagtgtccagttttttggcttycctgggcccattggaagaagaaraattgtcttgggcccacataaataaactacactaccaatasctgmtgagctwaaaaaaatcgcaaaaaaaaaaaaaaaanccngggcnntttnnnnaacnaannaaaacnnnaa

SEQ ID NO: 23271 - DNA, 900 bp, Homo sapiens
  misc_feature 2, 3, 4, 5, 6, 7, 8, 9, 12, 13, 14, 16, 19, 20, 29: n = A,T,C or G
gnnnnnnnnttnnngnccnntttgaaggngatgtatataactatctattcgatgatgaagataccccaccaaacccaaaaaaagagatytcksgrsgaycctcttsttggsgtagagttttcagattgctcttgggaaccatgccgaaagtagtgtctcggtcagtagtctgctctgacactcgggaccgggaggaatatgacgacggcgagaagcccctccatgtttactactgtttgtgcggccagatggtcctagtgctggactgccagttagagaaattgcccatgaggccccgggaccggtcccgtgtgattgatgctgccaaacatgcccataagttttgtaacacagaagatgaggagactatgtatctgcggagacctgaaggcattgaacgacagtacaggaagaaatgtgcaaagtgtggactgccgctcttctaccaatcccagccaaagaatgctcctgttaccttcattgtggatggagcagtagtcaagtttggccagggttttgggaaaacgaacatatatactcagaaacaagagcctcctaagaaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgagcaagaggcgactgcaagagctggctgaattggaagccaagaagcgaaatgaagggaccttgattgcaaccagttcaataccaggccttttctagcctaactaaggcagctttaatcagaggcaagtatttcttgatactaaacgattctttttgcctacaaagcttacgtgttcct

SEQ ID NO: 23272 - DNA, 855 bp, Homo sapiens
  misc_feature 2, 11, 13, 14, 26, 27, 36, 49, 51, 52, 70, 82, 727, 733,825, 826, 831, 832: n = A,T,C or G
anatacctgcncnnacgatcaacccnngccttgttncttttggaccgcncnncggcctacggctgcgagnaagtacgacagnaagggactgtaacgttttggtgtttgtatgttttgagacagagcaatagattgcctccatatcttttaaacattcaggtctcttgtataagaaaaataaccattgtggggtttttgtgcatcttatactaatatgaaacaaacaaaaccccctggatattttatccttagaaagatagaggaagacaggagaagggaatggtcattgtaaattagatagatatattgagtgttagaagattatttaaataattgttcttttgttatttgtactctttgcaaatttatttaaatgcatattcatgtatatcataagtatatattcacatgcatgtctaaatttagtggcatagatctatctcaggggtattaatctttcattcgtgtactgatttgtgttttattttcatttaaaaaattgtggaaccagtggctgggcatggtggctcatgcctgtaatcccagcactttgggaggctgaggcgggtggatcacctgagggtcaggagttcgagaccagcctggccaacatggtgaacccccccgtctctactaaaactacaaaaattagctcgcatggtggtagatgcctgtaatcccagctactcgggaggctgagacaggagaattgcttgaccctggaggnggaggntgcagtgagccgagatgcaccattgcactccacctaggcacagaccaaactctgttwaaaaaaaaaaaaaaaaaaammmwgggcccttttcnnatccnnctaaaaayttgtagtaccccccc

SEQ ID NO: 23273 - DNA, 972 bp, Homo sapiens
  misc_feature 857, 891, 904, 946, 949, 950, 953, 960, 969: n = A,T,C or G
gattctcttgtacttttatagtttccaaaagttctacagagagtgtaatgtaggaccttagtcaggaataaacatctctttaaataagcagcagagaatttcaaaggaagtgtgtggtatgggtttatgtrtwtctttcaagayctamtatyyyccwygttwgttgcttywgrammgacaasgtrmyttcrrcwrckwaaccccrtcrwcargagggtgttacttaagtacattatgggaggtcatagataaacaaccagtcagcctctaagcatcagaaaatccgtgatgtccattggcctgagagatggtctgcatttctttgaaggaaaaaagcaggttttaaaacactagaaccgaatcaaatcctaaatttgaatagaaagattagaaaggcttatgcatgggaaaaagattcagggtatccaacggttaattctgactatttctgagtaatttaaatttacctataatttaaaaaaaaaawtaaggtcaggtgtattgactcaaacctgtaatcccagcattttgggaggccgaggtgggtgaatcacttgagacgaggagtttgcgaccactatgggcaccatggcaaaacctcatatctactaaaaacacaaaaattagccaattggtggtggtgcttgtagtcccagctacttgggaggctgacgcmtgagaatcgcttgmacctagggggtggaggkkgcaataacccaagatctcaccactgcactccagtctggggtgacagagcaagaccttgtttcaaaaaaaatttttttgttttttaattaggaatcaaataagataattaaatgtaaacttacacttaatttactttttaagcattttanaattggattctaattttgggtcgggcattttaanaatcaataaattnttttaaagcaaaaaaaaaaaaaaaaaaaccctggggcgtttnccnnaanccaaatnaaaaacttngac

SEQ ID NO: 23274 - DNA, 838 bp, Homo sapiens
  misc_feature 9, 38, 593, 751, 786, 799, 809, 820, 834: n = A,T,C or G
gamgacagnaggggtctgctcataggggagcttctagnaaggaaggacttattgtcttagttacttgatccacttccttacctcctgttcatgcaactttgcttgttttgcttctactaaaatggttctaggtgctgtgtggacaggtgatacaaaagcctgactcacacggttgacattcattcattccattttcatttctctttgagtgatcctgacaagcagagggtctcaggtggatattactgtgtctttgagacctctctaatccttatctatctctcattttaatacagagagtttcatacgcagaccttaagtagacatagtatccagctaaaagggtctcactctgtcacccaggctggagtgcagtggcgcagtcatggctccctgtaacctcaacctctcagactccagcaatcctcctgcgacagagacagagtctcactttgttgctcaggctggagtgcattggcacaatcttggctccctgcaacctccgcctcccaggtttgagcgattcttttgcctcagcctcctgagtatctgggatgacaggtgcctgcccgaagtctcttttgccatataanggaggcagtcaatggtgaatgctggcctcgctgattactcacctggagacctttctgaggatcagttttctatctagaaatgggacactgcagacactgaagaaawacagaaacagcccacmmtcagctkgttgggtgctgcwgtcactkgatctganatttttctgcctgawgggacggatatctctcactncactgaatttatnatgagctttnaggggaggccnaagtattttcgctntggc

SEQ ID NO: 23275 - DNA, 889 bp, Homo sapiens
  misc_feature 2, 9: n = A,T,C or G
gncgacagnagggggacagctgggaattgctgaattagaactgcagaggttcctctacagcaaggtatctggggtatatggtcacacaaaggcagctgtattgagagacattgacctagcttaggagtctaactcataaaagagaaataaaagggggttaattattgtatgattattaatgatrgyaysatataatattaacgagctcattaatcatattaatgagcagagcttccttagatatatctgtttataatgaatgatacacatatagctctgatgccatagggggagagtaagaatgaacaaagaaataaaataatttttaaaaaatgatacaggcccacgtgtagtggttcatgcctgtaatcccataactttgggaggctgaggtgggaggattgcttaaagtcaagagttcaacaaaaattttaaaaattagctgggcatcgtggtgcatacctgtggtcccagctacttgggaggctgaggcaggaggattgcttgagccctggagttcgagcctgcagtgagctgtgatcacaccactgcactccagcctgggcaacagagtgagaccctgtctctaaaaaagaaaataaataattaaaaacatatatgataggccgggcacggtggctcacacctgtaatcccagcactctggaaggccgaggcaggtgcatcacctgaggtcaggagctgaagaccagcctggctaacatggtgaaaccccatctctactaagaatacaaaaattagccaggcgtggtggtgcacgcctgtggtcccagttgcttgagaggctgaggcaggagaatcgtttgaacctgggaggtggaggttgcagtgagccgagatcgtgccactgcactgcagcctggtgacag

SEQ ID NO: 23276 - DNA, 1105 bp, Homo sapiens
  misc_feature 2, 12, 1101: n = A,T,C or G
tncggctgcganrggaykayagagkkwtkakyamaakkawrywtgmtgccttaaraaaattamacmatcaastwststtraatagctkcykrkwwkgywttcaagtywgcaraaargrwawsaawkcarrcagytataaagaarwkywractgttwyytctattcawwwwgcaagaaaagtatattggtttgrgaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaaggtgkacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagakatgaactamatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaattggcttcaaagargatcttctattctagtgacwgtaatcacagagccggagacmtttgtcagccagaaaaaaaaaaaaaaaaaaaaccctggggcstttttataanacca

SEQ ID NO: 23277 - DNA, 871 bp, Homo sapiens
  misc_feature 5, 6, 7, 8, 13, 15, 27, 29, 37, 39, 45, 58, 74, 76, 77, 84,86, 122, 723, 739, 802, 832: n = A,T,C or G
ttttnnnntttanantcttggcctacnancccccttntnttgttncttttggccgcancggcctaggctgcgananncgacagnanggtatctaagttaatcacacacctcagtccatgggnacttraygaywgccagggattctattacttttcccctttgtttatctaaccctaatcccattcctgatcttctgtaagtattcactctaaggtatttgagatactttaaatcattgctaaaaatatatataggatagttgtgtaagtagcagtagaaggtagtggtacaaagcacatattctagagctctagactctggatatgatcctggctcaccacttactagccaggctactggccagtacttactgtagctgctgatcctggacaggctacttagactctgtgtttttcatttctttacttgtgaccctggcatggtatgcaggaaagtactctaaagttgagatttgtgcacatgaaacttagggatttgtgctctcaggatcagaatctgcagaagggaagaaagtaagattgggaagagggtgaatttgaattggtgcagttaaaaaaaaaaagctacacagcgtggcccatatgagttctcaagatgggatggcctttatgagttgtcatcaattggaaaagcagggctgagcttttataccccaccattaatcaccatagatgtgagcagttcccaaagggagcataccgngagccaggcrgctctnttyagctgcagactggacctggrragggactcamctgtaagcttctgagtgaaaactcttaantacctgaggagggaaaaagggggcmttgcnccggggwtccctaaatctgkaaaaattaaacacamcaaa

SEQ ID NO: 23278 - DNA, 766 bp, Homo sapiens
  misc_feature 4, 12: n = A,T,C or G
gacngtaggggnatggtagtgccccaggcactskggcacccagttttggaactgcagttttaaaagtcataaattgaatgaaaatgatagcaaaggtggaggtttttaaagagctatttataggtccctggacagcatcttttttcaattaggcagcaacctttttgccctatgccgtaacctgtgtctgcaacttcctctaattgggaaatagttaagcagattcatagagctgaatgataaaattgtactacgagatgcactgggactcaacgtgaccttatcaagtgagatggagtcttgccctgtctccaaggctggagcccaatggtgtgatcttggctcactgcaacctccacctcccaggttcaaacgtttctcctgcctcagcctcccaagtaactgggattacaggtacccaccaccatgcccagctaattttttgtatttttagtagagatggggtttcaccatggtggccaggcttagtctcaaactcctggcctcatgtctgcctgccttggcctcccaaagtgctgaaattacaggtgtgagccactgtgcccggccaacatttcttaacctagtartttagtttttatagttttattaccgcagtgaacgctccmccaaaaatttcattttgaattattaacmtaaaaagaaatattttgttttaaacttttaaactgaattttcaatavcattcmcaatcatattaaatgtttcaccttttmsaraaaaaamwaaawraamwwwawacccc

SEQ ID NO: 23279 - DNA, 802 bp, Homo sapiens
  misc_feature 760, 774, 779, 786: n = A,T,C or G
gcgctccgagctcggggacgcgcacgcacgcdgttgttggctgacttccggtggtgccaaagccgtttccgtggaatcaggccggctggtgagggtacagaatggaacaaaagtgggacttttaaaatgttgccctgtaagaagagaagaactacagtgacagagtccctacagcataaaggcaatcaagaggaaaacaacgtagacctagaatcagccgttaaaccagaatctgaccaggttaaggacttgagttcggtgtcactatcctgggatccaagtcatggcagagtagctggcttcgaagtacagtctttgcaggatgcaggaaatcagcttggtatggaggatacatctctgagctctggaatgctcacccagaacacaaatgtaccaattctagaaggtgttgatgtggccatctctcagggaatcaccctaccttccttggagtcttttcacccccttaatatacacattggtaaaggaaaactccacgctactggctcaaagagagggaaaaaaatgacactcaggcctgggccagttacccaagaagacagatgtgatcatcttaccctaaaggagcctttttcaggagagcctaktgragaagtcaaggaagaaggagggawgwcctcaaacwgarwkswgaaagrragatrccwttccatrtytyackywgsmatmtksaaaacwktaagccagmmakraaatcmccacagatgttgascytctstyagaaagcctcagactctgnttaccacctgaganaaaanaaaaggnggctctcttccatggc

SEQ ID NO: 23280 - DNA, 1246 bp, Homo sapiens
  misc_feature 1239, 1243, 1245: n = A,T,C or G
gggataaattaccttttcatgtaaagaaactagggttggagaaattactagtccgaggtcacatagttaatatgtagctatcaggatgtgaacctagacatttgaactcagctatattgcctacatcgatgattctaggaaaataaargkgaatkrccacatcaagcaaagtccatccttgagaaggcaagaggggatgtgaattggaatgcaagggaggactggtctttgaaaaagggatggtcctttcctccacggcattgaaagagaaggcaggtgcagatggccacagttgcctgcaggtgttttagtggtgagaagacaagacttcatatctaagagcttctcgtatttttaaagaagtcagaggttaagtaactggctgagactataataagagtgtgctctacgggtagaggttgagaaggcagaaaacacttaaaatcattatcttggggagttgggaagagatcttggattgtttggcagttttctgtgcctgtttgagatttttgatcatgaattttaaatgaaaccagtcacagttgtatgattttctgcagcaagacttagctgctgaagtgcaggcaggggtacgtgatagggtttagttggtgccaggattttgctaggattgtaaaaaaggaaaaaaggtttgagggagatgatgacattttgacaggaaagtgaccatattaaaggactggtgaaattcggctggatgaagagcaaagtgaagccagcacagatggggagaaagtcataggatctgtggacctcagtaagatcaatgatttgtagcagtggagatacttgagcaaataagatttaggaggtggtgatcagagagtgggctatcagaggtggttcagtctctgaatgtcatggttcaggttgtggccatgggagtggaaggctgaagtgaatagaggagagagaaaataacccagaataaggacacccagaaattatccccatttaatctcaattttctttcagagaggtcatgactttcatgaaggcgttagagctggtaagtggcaaatgggaacttaccattttggggaaatgggatttgtgagcatatgctgtaattaaagaagatmcagattatgcatcccaatcctaaatccaaaatgtaccmaaatctgaaacttttgasmccacatgacactcaatgttcwtkgaccwtagtttatgcaatattcaaatctaaaaaaaaaaaaaaaaaaaaaagcngccntnt

SEQ ID NO: 23281 - DNA, 855 bp, Homo sapiens
  misc_feature 2, 11, 13, 16, 20, 21, 32, 43, 45, 52, 797, 851: n = A,T,C or G
antacttgggntncgntaanncttgtttgttncttttggccgnancggcctnaggctgsgrkagkacgacagcaggggccttcccaggcggggatgctgcggctccgcagcgggctgaggcaccttcgggcaacacccaatactcggggctccgctcggcttcttcgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaaacaaaatgctgtaacagatttgacagcagaggctgtaaatgtagctattgcagcacctccatcagagggagaggctaatgctgagctctgtcggtatctttccaaggtcctagaactcaggaagagtgatgtggttttggataagggtggtaaatctcgtgaaaaggtggtgaagcttttggcttctacaactccagaagagatcttggagaaattaaaaaaggaagccaaaaaaacataaaagcaagaaatgaggccgggcgcagtggctcatgcctgtaatcccagcactttgggaggccgtggtgggcggatcacctgaggtcaggagttcgagaccagcctgaccaacatggtgaaaccccatctctmcgaaaatacaaattagccagatgtgatggcgcatgcctgtattccagtactcaggaggctgaggcaggagaatacttgacctgggggcggaggttgcagtaaccgaatccnccgttgccttcacctggcacagatgaactctttccccgaaaaaaataaaaactncttg

SEQ ID NO: 23282 - DNA, 966 bp, Homo sapiens
  misc_feature 28, 59, 143, 790, 811, 816, 876, 879, 899, 903, 909, 917,921, 923, 929, 930, 933, 944, 954, 962, 963: n = A,T,C or G
gcctccacagtcccagagggatgtcccntcctggtccatggtctcatgttcaattcccncctatgagtagaacatgcgggtgttggtttttatccttgcgatagtttactgagaatgatgatttccaatttcatccatgtccntacaaaggacatgaactcatccattttttatggctgcatagtattccrkggtgtatatgtgccacmttttcttaatccagtctatcattgttggayatttgggttggttccaagtctttgctattgtgaatagtgccgcaataaacatamgtgtgcatgtgtctttatagcagcatgatttatartcctttgggtatatacccagtaatrggatggctgggtcaaatggtatttctagttctagatccctgaggaatcgccacactgacttccacaatggttgaactagtwtacagtcccaccaacagtgtaaaagtgttcytatttctccacatcctctccagcacctgttgtttcctgactttttaatgattgccattctaactggtgtgagatggtatctcattgtggttttgatttgcatttctctgatggccagtgatggtgagcattttttcatgtgwttcttggctgcataaatgtcttcttttgagaagtgymtkttcarwrmkawgmaatatttgcmmtaaaawakgatgagttcatgtmywtkgwakggttamakggawgaawtykraaatyatymtwmwyagtataaastatytgaagsmcwamwrwcswaacaccacatgttctcactcacaggngggaattgaacatgagaaccntggancaggaagaggacatcacactctgggactgtttgggttggggaggagggaggataccttanganaatcctatgctaatgacaantaanggggcnccaccacntggncngttacnntgnactaactgccntgggccatgnccctaaannaaa

SEQ ID NO: 23283 - DNA, 947 bp, Homo sapiens
  misc_feature 5, 834, 870, 890, 906, 909, 914, 918: n = A,T,C or G
agggnagttcttccagggkymgatatgkckgcackwkatttcatagatggagaaactgakcacagagctgtaatgaagacagaattgagatatragggcaaaagctaattaaacgcatcctcacaggtagcctttctttcagtgaacctgtagactagtccagtaatacttattaaaattagttgttagaggctgggcatggtggttcaagcctgtaatctcagcactgtgggaggccaaggcggacagatcactcaaagtcagaagttcgagaccagcttggccaacatggcaaaaccctgtctctactaaaaatacaaaaattagttgggtgtggtggcacatgcctgtaatcccagccactcgggaggtgaaggcacaagaattggttgaacctgggaagcagaggttgcagtgagctgagattgcactgctgcactccagcataggcgtcagaataagactctgtcttggaaagaagaaaaaaaattgttagcctaaaaccaactctctctaaatttaaaagagtgattatttatcttagtatttatagaagtatgagattatcagaaggtgcgatgcacaatgctcattattttatcctagtacaagacacgtataacatctaacagtaaagaagatggaatctttctataaaaacaattctgttattaatagttgactgacttcagtactttgaggagkagaatgaacttttaggcagawctttccmcatcmctcattgtattkgtcaaattcatagaaattacttgcaatatwttgatttaagccttatgtagtgactggtgctatatttgaagcaacatttttagnttgctggttttctcactgcttatcctcaaaaaccancctctgcctaaaaaaaaaanaccaaaatgaatcagnccnccggnttcnaaaatattatttttattaaactggaaggg

SEQ ID NO: 23284 - DNA, 1053 bp, Homo sapiens
  misc_feature 2, 13, 17, 18, 738, 744, 753, 779, 825, 837, 887, 890, 891,902, 903, 924, 949, 953, 976, 985, 1019, 1026, 1027, 1028,1029, 1032: n = A,T,C or G
tncggctgcgagnaagnngacagaagggatgagagagaccctggaaaacattatggaaataagcctataggaatgggrgstactttcatmwttywgaagggammagtgaagkcymacmtggyawgcctgcagaattttcttcctgccccttgaactctgatgaagaagtgaataaatggttgcatttttatgaaatgaaagctcctttggtttgtctaccagtttttgtctccagagacccagggttygatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattggatagtatattctatattatttcatanatctgnctgaaaganattgggaacaaaatatctaatgaaanaattctttaatttttacataacagcttttatttttttttctggagntcacgaaaymrncctgttatacctgatttaawwtcaggatctgccatttttttcttgtttanaannctttatttggnnacattttacctttgcaattantcccaccgcaaaaaaagtttttgantttnaaaaaaagggttttccccggggnttttaaaantttgaaaaaaaaaaaaaaaaaaaaaccggggggnttttttnnnnccnataaaattttgggggcccccc

SEQ ID NO: 23285 - DNA, 591 bp, Homo sapiens
  misc_feature 18, 19, 44, 49, 51, 55, 56, 64, 66, 69, 80, 81, 82, 84, 88,91, 104, 107, 108, 110, 111, 114, 118, 119, 128, 129, 131,133, 134, 137, 139, 140, 145, 146, 152, 155, 157, 158, 164,165, 167, 173, 180, 182, 183, 184, 188, 191, 195, 201: n = A,T,C or G
  misc_feature 204, 207, 208, 221, 223, 224, 225, 229, 231, 241, 245, 246,247, 255, 259, 269, 271, 279, 283, 305, 308, 315, 332, 334,338, 343, 375, 392, 398, 408, 416, 421, 424, 438, 440, 458,467, 477, 490, 513, 524, 528, 531, 557, 558, 570, 572: n = A,T,C or G
  misc_feature 576, 585, 586, 587: n = A,T,C or G
tttttttttttttttggnngggggggttggttttaaaacccccngcccngnaaanncttttttnancanccttggaaaannnancccngcnttttttccccccnttnntnnaanggannttttaaaannangnnggncnnggggnncttttngcnannttgggnntngggggnctaaccngnnnaatntgncctnggaaangtngtnnccaatggaagggntnnngccntnaaaaattttntttnnnattttttnatanccaagggccntntaatcctngttnaaacaacctttggagggaaaanaanaaccaanatttttggccccggacnangttnttggncccttttttcctttttttttttttaagggggnggttttaccaaggggcngggggnaaaaagttancctgaaanttttnaanggaaaacctccggncncatttgggatttttgccnggccctttnggggggttcnaaagcttttttgnccttggcaatttggagccttttnggggggcatantttnaangcccttttttggcccccaaaaggganntttgccttaatncntttnaaagaaaannnaaac

SEQ ID NO: 23286 - DNA, 948 bp, Homo sapiens
  misc_feature 4, 801, 843, 846, 862, 895, 943, 944: n = A,T,C or G
accnkggggaactcrrattckycwkgwgkgaagtaagcaatctattttcacttgctattaacagcaaacgtacaactttatctcttatttgacttcattatttggctttcaaattaacaacatgaaaactatacagaaattagtctgtgccctataagacagagatttagataatttgttcaaaacatgagatgatattcagatattctctcaaaggcaggactccaacaccgcaggtggaaaaccaacaaaaggaagaaaacagaaaggtgggggagataaggagtagccaggaaaaagaaaatagtgataaaggaagagccaaaaaggaggaaagggaagatgaaagaccgacttcaagaactaaagcagagaacaaaggaaattgaactctctagagacagtcatgtatcaactacagaaacagaggaacaaggggtgtttctacagcaagctgttatttatgaaagagagcctgtagctgagagacacctacatgaaatccaaaaactacaggaaagtattaacaatttggcagataatgttcaaaaatttgggcagcaacagaaaagtctggtggcttcaatgagaaggtttagtctacttaagagagagtctaccattacaaaggagataaaaattcaggcagaatacatcaacagaagtttgaatgatttagttaaagaagttaaaaagtcagaggktgaaaatggkccwtcttyagtggtcmcaaggatacttaaatctcarcatgctgsaatgktccgccattttcagcaaatcwtgtttatwtmcatgacncatagcagcaagcaggagagtgcaagacatttattttacgtngcnttgaattgtggaaaanaatgtctgaaaaaatgtaatgattgcttctcangaaaggggagttttatgaagctacttccgatcattcctagccactttnnaatg

SEQ ID NO: 23287 - DNA, 874 bp, Homo sapiens
  misc_feature 765, 802, 822, 825, 830, 852, 854, 864: n = A,T,C or G
aggggattcatttgctcgcgtgcaggggaagtctggagaaggcattgtttcaattattaaaagtgtgggggcagtgggcggaacaaacgcgccgactacagaggctggacgtaagcttagcggtggcgcgcgtgcgcagcgccggcccgagttgccaaaacaaaggggatttggtgatggaggctttgttagaaggaatacaaaatcgagggcatggtgggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggttggaatgttgcatcagcaggtagaagaacatgaaaaaatcaagcaagagatgaccatggaatataagcaggagttgaagaaactacatgaagaattatgcatactgaagagaagctatgaaaagcttcagaaaaagcaaatgagggaattcagaggaaataccaaaaatccagggaagatcggtctgaaattgagaggttaactgcaaaatagaggaattccgtcagaaatcgctggactgggaraagcacgcttgatttatcagcaacaggtwtcttactggaggcacaaggaagctctgctgacatcaaratattcagctcacttgtcatcgaacaaaattaagctgggacttytaccatcanaattcacacttaacmgtaactggrccggctatgcctntctggccatgagtggaatanacnctacntgagggcatgacttgttggacnanttactgtctnagacacacaa

SEQ ID NO: 23288 - DNA, 1129 bp, Homo sapiens
  misc_feature 13, 1018, 1051, 1069, 1108, 1110, 1112: n = A,T,C or G
ggggtggtcaggnaaagtatttggtgataggatgcaattcaggcctagaccaaggtttaaatgttctctcttctattagcctcacttggcaacaggtactggctgatcctgggcttcatctgaaggagatggaggccagtgaaccytttggttacmskrasgwgarssmctgkakkwkgkkgcwkwtggacygsaasmgrsyytggsasrgsmkgcgtataatasgamagcwgggaggggaatatggaggtgctgttgaggagctctaggaactttactgagtcagaaaaatttttctacagacagtgtgaaagagcctcagtagtttgactgagatttgaattatttagctgttttttggcttcttaataccaagtgaaataagcagaccgctgtgcatccaaaagctttgttcctttttgctctagggctgtttttagatggactaatttagggatataccaggagcccccaccatagccgaagagagtttttggtaaggctttgccagtgagaaagcaagcagacagtattagaactatagcggcaaagcaggagtttgataaggtgaggtttcaattgagaagttcccatgggagaagcaggattaaacagacagaagagagaggcctcataaagagcagggaaaaaattccagcccaggcattggggagtggatccccactggaaacaaagagccaggagaagtcttcatcccaggagacaaagatccaggaagaattttccagccaagagccaggctcaggagtcagggagtaaatgtcttcttgacgcagtgagccccagaaagaaagacttctagctgagtagatgcctttcaaacaaagaagtctgggcctctaatccagcttcagacaatgtaatcagaatcttcwtcaaaatctgtcctcactgtgattcgatggrcatttatctggagcactggatatttggratcactcaccaccagatmcccaaaagcaagcagactgaagacaagtcttgggtgtgtgcttanaaattggttattgtgtccaaagttattggtggntcagatccagatctaatntggacaaaaaaaaaaaaaaaaaaaccctgggcctttttntnanccaattaattcttggtt

SEQ ID NO: 23289 - DNA, 942 bp, Homo sapiens
  misc_feature 5, 6, 7, 8, 9, 10, 11, 33, 39, 52, 66, 67, 68, 70, 71, 78,80, 87, 752, 775, 850, 857, 858, 861, 863, 868, 869, 876,878, 880, 888, 892, 901, 922: n = A,T,C or G
ttttnnnnnnntacgggctacaatcccccttgnttgttncttttggccgcancggcctcggcgcgnnnanncgacagnangggcagnaattcttagtgtgaaggtgatgtaccacttcagatcagttttcactggagagacttgtaattggtagctgtagctcgtatccatccctagtcactttgccaggatgaatgctgttgggcagcagtagcctaagttacggaaggggagcagattgaatggggttttgagacatcttctctgataccttagctttccttctgctctggtcgctatccactcagtcgtgtgctagaaatgtttaacaaccaggatctctggggtgggggtgggggggagcgctgaatttgtagcatttgctgcaaatataaattataaataaaattctaatataaattagaattttatatcaaattctttgatataaatkagttactcctcctgtggctgrtttcaagctaccacctttagagttcagaaaggatgtgcacaggytggctcagagccagtgctggcaaaccattgcatttactccacccaagagtggattttsacataatttctaaaataattttttcttatttatatactgacttttcaaaatacaaaattaaaatatcaygtctgacttcagkgatcttttyctttttctttttttaaaaatgagatctttcagtaatccttaattyaattktttaagawggagtcttggggtggtaccccagggnggactcaacctcccggcctcagngatcctcctgcctmaacctcctgcgtagctggcytcargcatgcgcaccccacctggctwatatccttctttatnatgggtnnccnanaacgnngggaagntntnttgctcanggcntacttatgnggtcaacaaaggggaattccnttgtttttttttaaaggagg

SEQ ID NO: 23290 - DNA, 927 bp, Homo sapiens
  misc_feature 893, 909, 910, 927: n = A,T,C or G
ggggtagaaacggggtgtccgcatgttgcccacgctggtctctaacwyctrggstcacatcgttmacccaccttggcctcccawrttgctgggwttrsmmgcatsrgccactgcgsctgcgtscaggasgamagtwkkkagaaaaaggtgcacaagaaagagcataggattgtgccagcattgatgttatcttctggttatatgagagtgttttgccaagaatcggtcaaatgttttacattagggaaaaagcattattgttactggcatagggagggccccagttaaaatagcagtccaattcagagaccttcgtatttgtcgttaagatcaaaaggactcttggaataatggactatgctacaggattattttaagttcagatagataaattagcttcttcccaaattctcattctgcttttcctgtggtactgtatagtatcatgaagttatatctttaaactcttagtttgtactatgtggtgtcttatgaaaaccttgatttgtttatacttagtgaatgaaacacttgggtttaaagttctttaactgatgtcacttcttaggctagaaagctgttgaaagaacttagtgttccacccttagaccaaggttcatgtcaccatatttaacagcagctttgtattacggtcaagattgtttgaagaattcagcatacaaacttaatttacagatgcaagcctgcagatggacctccccacccccacttttttgctttagawtaggttgtgactggaggaaatttagttttcctttgccttcagttatttgcagctgttcacatttatgatgatgagatgatgatgatgataatgtatttaggatymwgtgagagraraaaamtawyyttttcttctatagttattcccnttctatttcctcttgnnttgcttcttctcccgcn

SEQ ID NO: 23291 - DNA, 1096 bp, Homo sapiens
ggggcttttggcacaatgttgcaaggaactctatttttgacatgcattaatcttttattkkgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaatcccagcactttgggaggctgaggcaggcagatcatgatgtcaggagtttgagaccagcctggccaatatggtgaaaccctgtctctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaacacaatctttaragagaaaagacatgaacaactccaaatatccatttaatcaatcatgtttttgctttggataaaaacttgaacagtttttttctaggactgcaatggaccttaattwwgacwtgagaatgaagaaattattttggaaaaaaaaatgacctaatttacctatcagtgaaagctttattttctgg

SEQ ID NO: 23292 - DNA, 880 bp, Homo sapiens
  misc_feature 1, 9, 22, 747, 785, 815, 835, 846, 848, 853, 854, 856, 860,861: n = A,T,C or G
nacgacagnagggtaatctagnaaacatagaataactcttggtacatctgttacatagttaaggaaagaaacaggcaggtgaggctggagaamgkkgwctatttgtrggmrataaagtcaktgcagacgcwtrttctagtttrgmsktagattamtaykgygsttagtgratkwcwatgacatatttctgagaacactttaatatatttccacacctactggaatctaattcagtcgatcggataaaagaaagacttttttgttgttgtttttgaaaatccataatgtagcaggttctgcgctggttttttaatgtattttatttttgtgctctcctgccaaaagaaaaggctgataagtaagtacacagtacaacatgtaaatttgtataaaaatatgcttgtttagattgctctacaataactatattaaggtaaattgtgtgtgtgtgtgagagagagagagagagagagagaaacagagggagaattgactcaatgtgttttctatgaagagtcttagcttaagaatcaggtaacagagaggtcctagaccatagacccagccatcaactagcttgctgatgttgaacagatcaactctcaccatagactgaagatggaatgaagatwtcaaaagttccttttagcactgactagattttttttttttttttaaaacaarrkmtctctttttccccmggctggattcaakggatggkcgggctgmctgaaccctccttttccngggttcaagggattctccycccycmccctcckgagggngggrttacgggccawaaccccccccccagntwacttttgtttttttgganaaarggggktncntttgnncnaaannggcaaaacccggcccaagg

SEQ ID NO: 23293 - DNA, 799 bp, Homo sapiens
  misc_feature 40, 41, 720, 781: n = A,T,C or G
ttcattagtaacttttcagtgacccaaaatggatactttnntggttatataagtataaattagtatattaggtaagggaaagagtttagtgcacctttaaagaaaaaatggttttartygatgcascattttakkgtatatttctttacatagtgagaagggggcacatgaggtcagcagtcaagttttcaggttaatgtcgtctttgtcacacacctccttttgtgggttggcgatacttttatttatgagctcgaaattctccacttagcacactattaaggtggaaattggaaggctgatatcagtggcctaaacctgaagttctcgtacgttagtaggcatgaataccttgttaagaatctgggccttcatgtaaaaaagattctctacagacccttaggtgaacaacggaaatctcaggttttctctctgtagtctagaagawtctgaaatagccctcagaggacacgtaagaactgttaaaaactacaccaccgctcttagttggaggacagaagtggcatgcaggactcactttaccctatcttgttcctcatttctccctactttatwttaattctaaagagatacggagtaaaatatgtgtcstatttggaagcagtacttccacagaattttagagcacaaaaattaatttcaggcatcagtcctctatcttatattaacatattatcttattaagataaattttattangaggctgaggcgggtggatcacctgaggtcaggagttcaagaccagcctgactaacatggngaaaccccatctctgctg

SEQ ID NO: 23294 - DNA, 920 bp, Homo sapiens
  misc_feature 602, 613, 644, 686, 690, 702, 739, 743, 761, 792, 795, 796,807, 820, 828, 831, 833, 843, 847, 851, 866, 877, 904, 909,910, 915, 918: n = A,T,C or G
gggggagttctactttatgctctgwmkwyaraarkkagtgacctcaaagcagagttgatgacacaggctttggggccctcatgttcttgtctttagaacatatcactactaagtatcagcttatcttcagaacattacaacattcaccgtgttcatatgctttctgagaagtcaccacttgtaatttcagatcacatacacctgaaggcattttatagttcctaaagttaacatgttagatcttttttttccaccccatgagggtctcactctcacccaggctggaatgcagtggtgtgattgtagcacactttggccaccaactcctgggctcaagtgatcctcctgctttggcctcctctgagaagctgggattactggtgcacaccaccacacctggctaattttttatttttttttatttttggaaatagggtatggctatgttgccttgggcccgtcatgaactcctagcctcaggtgaccctcccacctcaggcctcccaaagggttgggattacaggagtgagctactgcactgggccaacatgttaatttttttttttttttttgaaagggagtcycccaggcggaaatgcaanggggcaatctnaatttcmctgaatttttcccctcccgggttnragcgattytccccctaaccctcctgagwagctgggattamnggcncctgccatcacnctgggttaatttttgttttttgacaaaaaggagtttncccntgtgggcaggggattggnctcccctcccccacctttccaaagggtgggnttnngggttaacccnaaccccctccccnccaaatgnaantntaatttgggntttntccngggggttgggggggnaaaaaaccttnaaaaaaaaaaaaaaaaacccggggccnttttnnaaaanaanaa

SEQ ID NO: 23295 - DNA, 918 bp, Homo sapiens
  misc_feature 761, 776, 786, 798, 800, 810, 812, 815, 829, 851, 862, 867,871: n = A,T,C or G
ggggctcctsssggggtttgtagcggaggaggagcgggcgccatggcggttctactggagaccactttaggcgacgtcgtcatcgacttgtacaccgaagaacggccgcgtgcctgcttgaatttcttgaaactgtgcaaaataaaatattacaattattgccttattcacaatgtacagagggattttatcatacaaactggcgatcctacagggactggccgtggaggagagtctatctttggccaactgtatggtgatcaagcaagcttttttgaggcagaaaaagtcccaagaattaagcacaagaagaaaggcacagtgtccatggtgaataatggcagtgatcaacatggatctcagtttcttatcaccacaggagaaaatctagattatcttgatggtgtccatacggtgtttggtgaggtgacagaaggcatggacataattaagaaaattaatgagacctttgttgacaaggactttgtaccatatcaggatatcaggataaatcatacggtgattttagatgatccatttgatgaccctcctgatttattaatccctgatcgatcaccagaacctacaagggaacaattagatagtggtcgaataggagcagatgaagaaattgatgatttcaaaggaagatcagctgaggaagtagaaaaataaaggcagaaaaagaggcttaaactcaggctttcttttggagatgggggagacctactgatgcaatttaacctcaaaatgtctgttgngtgtaatgaccatgnccaatgagantgaatatttctntnattggcatananttngagttccaactganaagaatccttgtcctttgattnaagaaaatggnaactntaangcatgcttaaaaaaactggtttccccgtgagtaagagaagggaacag

SEQ ID NO: 23296 - DNA, 988 bp, Homo sapiens
  misc_feature 2, 4, 11, 19, 30, 41, 43, 50, 71, 815, 845, 869, 895, 920,922, 932, 934, 942, 946, 954, 967, 970: n = A,T,C or G
antnttgggtncgataaancttgcttgttncttttggccgnancggcctncggctgcgakargacgacagnagggggtgaatcrcwgggckcwmaasgyrrwstggaagryasmmtstyayrryrmtrgakwcataawagasryctattcatsgaatwwgtkaaagarkakctstgtkctkagatgragrgaatcctcaatktcawgatytgvagaaraagccagaagacatctaggacatccataaaaattcatcagagagcattttactactgagctgcaaaggtaggaaaaataaattttttttggttagaaaatatacttctttcatctgcgtttcaataatttattccccttgttagatatacatggaattgatattgcttattctgactaagtgaaaagtgttatttctacttactgctcaattagaaacatgtagtgtttaattgtcagtttgaatttttctttcatactattacagtttatattttactataggcagaatttcctctttatcctaaattttgatattctccataatttcatcgtgccttgacattgctgtatataatttctatacatcaggaaggcaattctgtgtgcatgtgtgtgtgtatatatatagttagaagttagaaactgaaactcttttttgtctaccatcatttcatatttttcttgctatttcaaacctataattttaaagaaacgactaacgtatcattcatagaatatgctgtcagtaacttaacatttaaatgttacatggaggcmtttagttcagcatttgcttactaatagaggcaaaaaknggccctttctmgttagggggatgggaaganaawttaaaattctaaactagaaanacctctctgaaatactaatatagctnttcaaccaatggtaattgggggatntnggaatggcanangaggcacncccncccttcanccctttctatcanaanttgcggctaaaacgacgg

SEQ ID NO: 23297 - DNA, 1694 bp, Homo sapiens
  misc_feature 14, 15, 16, 17, 18, 19, 20, 24, 27, 34, 40, 44, 96, 1661,1664, 1667, 1671, 1675, 1678, 1684, 1688: n = A,T,C or G
tttgaaggcccttnnnnnnntttnganagccctnccagcnggcnagcgtttaaacttaagcttggtacccgagctcggatccactagtccagtgtngtgggaattcatcacagactgsgsaskrggtcaggggttgcgagggctgccccaagtcctaccgggtttgcacgggcgcgcccggctccgcccgcaagtgcgccttcctgacttactgctgggtgcgcggggctgggggtgcgagtaccacccctgaagtctcttcctgggcgacctccggggcctcattctaggcctccttaaagagaaggatctaaattaggaaaaggaagtgcccttatccacgaccaagctcttccacctgcggagctcgcttagtctgcacctcaaccgtgcggaaagtgactgcctgtttactgaggaaaaactggggctcagaaagataccatggagtagtttgaaacaggaacaaaatcttctgaaagctcggagcaraagcctttttggtcaacatggaggaaaaaagacggcgagcccsagttcagggagcctgggctgcccctgttaaaagccaggccattgctcagccagctaccactgctaagagccatctccassrgaagcctggccagacctggaagaacaaagtagcatcatctctctgacagagtagtttgtgttcaaagaacctcarcaggtagtacgtagagctbctgagccacgagtgattgacagagagggtgtgtatgaaatcagcctgtcacccacaggtgtatctagggtctgtttgtatcctggctttgttgacgtgaaagaagctgactggatattggaacagctttgtcaagatgttccctggaaacagaggaccggcatcagagaggatataacttatcagcaaccaagacttacagcatggtatggagaacttccttacacttattcaagaatcactatggaaccaaatcctcactggcaccctgtgctgcgcacactaaagaaccgcattgaagagaacactggccacaccttcaactccttactctgcaatctttatcgcaatgagaaggacagcgtggactggcacagtgatgatgaaccctcactagggaggtgccccattattgcttcactaagttttggtgccacacgcacatttgagatgagaaagaagccaccaccagaagagaatggagastacacatatgtggaaagagtgaagatacccttggatcatggkaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaaccttccactgagaagccacttcaagaggctggtgctgctagatctcatgatgtggctgttgggaagatggtggggtttgtttgccagcttggagtcctattaaatgaaagccagcamctcatggttggtaataggtctactgtgggaacagttatcccttaaccayagctcaaatggctatatctttaggcaattaaatcttgtggcagtgctcaaaaaaaaaaaaaaaaaccctggggcgtttttncgnaanccanttanaancttggnagtncccccc

SEQ ID NO: 23298 - DNA, 790 bp, Homo sapiens
  misc_feature 5, 14, 20, 33, 44, 46, 53, 63, 324, 336, 340, 386, 457, 462,493, 497, 504, 789: n = A,T,C or G
tttantttggggtncgaaanccttgttttgttncttttggccgnancggcctncggctgcganagthaacdggggtgraaaacccccwttycttgwtccttttggccgmagcggccttcggctgcggaaattckacagaatgggatattatctgtgtagtagcctgtttaaagtgatcattgctagtgcatggtatagaattacaaacttgtaaatacttctcaagattgccactttaaaaaaaaaagcaaaaagagctctgtagccctatttttttttttatttccaacaggaaatttgttcttgtttcaaaaggggggaacncccattattctntgtnggccacatgaatgtcatccatttgtttattgcagcaaaaaaaaagngaaaaatggttgatacaggggcaagctgttccttttaggttactttaaaaagtcatggaatttcggatttncaaanaaagcttaaggaatactctaaccagtttatntgtntacagtntccagtttaaaaatgaaaatgtaatgtagttattaaaacattatgtgkgggcttccacaagcctgtcctcctttctaccttccaaaagaaacttctctcttgaatttggggttcgtcattctggggcatgcttttacagttttacaaaatacacacccattcccaaacataaataatactgtttcacaacataaattgkattatgggacatgttttaaaacacaatatacattgtatctgttgcaagtcaggktccmagggaaatgggactcaaaaawtaaggcng

SEQ ID NO: 23299 - DNA, 806 bp, Homo sapiens
  misc_feature 7, 8, 25, 32, 34, 35, 36, 58, 741, 753, 758, 781, 798, 802,803, 805: n = A,T,C or G
tacactnngggggaaaaaacccggnttttttngnnnctttwsgaccgtagggggacanctcgcgggggatkggtttccacactgtggaagctttgttcttttygttttttgcagtaaatcttgctgctgctcgctttttgggtccacattgctttcatgagctgtaccactcaccgtgaagatctgcagcttcacttcagagcctagcgagaccacgagctcactgaaaacaaacaactccagacgcgctgtcttaagagctataacactcaccgcgaaggtgtgcagtttcactcctgagctagtgagactacaaagccactggaacgaagaaactccaaccacgtttgaacatcagaaggggcagactccagacacttcatcttaagagctgtaacactcactgtgaaggtctgcagcttcactcctgagccagcgagaccacgaaccgatctgaacatcagaagggacagactccagacgcgccaccttaagagctgtaatactcactgcaagggtctgcagcttcattcttgaagtcagaccaagaacccagcaattcccaacacacagggaccagcttctttcctaactcacttaggctcttcgtgctgctctggcaactaacacccttggctgcaggggcttggacgctacccttagtcactgacaattgtgtgaaggctgctgtcgttaacttcacttgatcaccttaggctcctgggaagtggkgagcawttnaaaaattcttgngtcanatcatcattagaagaaagaagancacttggagggtgctgnaaanncng

SEQ ID NO: 23300 - DNA, 846 bp, Homo sapiens
  misc_feature 14, 16, 31, 44: n = A,T,C or G
ttttttgacctacnancccccttgcttgttncttttggccgcancggcswamkrmtsykaaaktwmsacakcarsktatagtttaaatctaaataawtatgtgagaagaaccctttgttatttgaaggggatgtttgaagattttgtaaccgtgccttttaggtagtcctaaatttctaattgtagttaaaaacatgccattttcatttctaacattttaagtatatggtttagaagtggtaagtatagttctattttttttgcaataggttttagataatttttgtcttacaaaagtaaaagtgaatactcattaattctgaaacaagttagttagcttgctttagttagatagcaagagaagggtccctggaaagtccctggcccttgggtcagtgtctcatccctgcataacataaaaggaatcctggaaaaaatcaagctgcagacactaacaaggtaactagcacatggtgttgtgcttggagacctgcccatggctgcacagacagaaaaacctctggcacatttggataaaaacttgtacaaacctccagctcactgagataagggaacaagaccgacctggcatagaaatgcctttgtttgtccaggcacggtggctcatgcccgtaattccagcaatttggaggcagaagtgggcggatcacctgaggcsgggagttcgagaccagcatgaccacatggagaaawatacaaaattagccggcatggtgccctgsctggcasctcatgcctgratcccasmtacttggaggctgaggcggagaatcacttaawcccaggtggcggagtttgctgtgggccgagatcgcaccattgcac

SEQ ID NO: 23301 - DNA, 871 bp, Homo sapiens
  misc_feature 2, 9, 801: n = A,T,C or G
gnagacagnagggtgctcatggtcctctgggcaacctgacagkgscagcagattctgcagcatcttgactcagttactgcccaagaaccctgacaactccacaagggttttatttttaaaagtctacttcttccctacaatatagaacttccagaaaaggagctgactcccatgaagggcaagcagagccaaaagcaagtactatgcaagtgaaaactactttctaatcaagattttacaaatatatttcttttttttttgaracggagtctcgctttgtcccccaggctaragtgcagkggtgccatctcggctcactgcaacctccaccccccaggttcaagcaattctgtctcagcctcctgagtagctgggattacagkgcccgccactacgcctggctaatttttttgtatttttagtaragacgggtttcaccatttgagccagactggtcttgaactcctgaccttgtgatctgcccgcttcagcctcccaaggtgctgggattacaggcatgagccaccgcacggggctgagattatataaatatatttcaaggaataggaagctgttattcccatgtgttgccttctctaaagaacatcagctgtgattaaatgtcctttcagkggaraaattttcactgctccaagtcaaagcagtatatacttttaacaaatgattttatcctgagtttttaattatccaagaccatattccttaacgttttattctggctgctggggggactgarttacaggactatgcgtcactgctgagggcttatgaggaccttgnargtactatttaasyttttgggtgaaagccctgrgtaaaaaaattcatgacttwataaaytactttstgg

SEQ ID NO: 23302 - DNA, 862 bp, Homo sapiens
  misc_feature 6, 12, 15, 27, 38, 40, 47, 57, 60, 68, 835, 836, 838, 855: n = A,T,C or G
ttaccntacganaanccttgcttgttncttttggccgnancggcctncggctgcganagnacgacagnaggggtaaatcatggtcagttcttatgggccttgtaagccaagttaagaacattcaagatgaaagaacatgaggaggttgacagktmrgatggacctccctggcagccgagtctgtggagtgaagggagggaagttaaaaacattcgagatgaaagaatgtgaggaagtttgcagttcagatggacctccgtggcatctgagtctgtggagtgaagggagggcacgcttggaggcggggccttcaggccttcctgcgcttgtgtctgtgagataaaggcctgaactaaggtaacagggaaggagaaaatgaaactgaaggaggtaaactggaatttggagactgacgaggagagaaaggaaagcattccagggaaaccccagttttttgcttggctactttgggtaggtgatggtgtcattaaccagaatcaaaaatgtcagtggtagattagatttgagtggggaaataaaaagttctctttgagatacaccaaatttgaggtacttgtggatttcccagaggcatcctacataggcacttaggaagagagccaggggattcagggtgattgtgtaggtagcaggtagccaaggcgtaaaggagactacmaggaaaaagttgtgtgaagagagacaagaacctaggacagaaagcctgagaacaaaatatcttgtgggctggggaaggggaactggctaagtgtmctggaagggaatggcctaaaagtccatmcamaaaaaaaaaaaaaaaacctggcccttttcnnanccattaaacttgagtgnccccccc

SEQ ID NO: 23303 - DNA, 1478 bp, Homo sapiens
  misc_feature 436, 448, 468, 472, 484, 496, 499, 511, 530, 625, 628, 634,644, 687, 691, 698, 699, 718, 719, 729, 740, 743, 774, 783,790, 832, 872, 873, 881, 895, 900, 908, 914, 921, 923, 927,928, 959, 968, 971, 973, 983, 993, 1005, 1020, 1022: n = A,T,C or G
  misc_feature 1033, 1096, 1175, 1208, 1211, 1248, 1250: n = A,T,C or G
caggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggsaggtgaccattggcacacgctagaagtttatggcagagctttacaaataaaaaaaaaaytkktttttccactgtcgctntagaacttcgtntctgtggtcttttttgtggncgcngaacggggctcnggggtgtggcanganaacgaacacaanggggggaccggctcggggntccaaaatacaacggaggggtccgggccgcgctgcgctatggaaggcaggtcaatgcagctgaaaaggaggaaaggccaacaaggaccctgaagngtncggacnacataggatnataacctgtactagagtactaactggaaggatctcatataagnctangaatganntaccaaaatggtaaccggnntgccaggaanccactacaagnatnggtaacgagcaagcatataaaaacaacaganaaggagttncgcgatngaggaaaatggacaaacataaaggggttctcgtatgcacatnaacacgcacgttagaggatgaagcttgcttacatggacgnnaaaaaagntattagatgagganaattncagaaganaagggncaacggnangccnncaataagataccaatgagtacgggaagatgntattacaantangnatggaaacgngacttaaagnagattaaagatnagtttaagaagttgnangagattaaaanaatttgaaggcgatcttttaaaaagagattaaaccgaaggtgattaaaagaccttgaaatacnatgacgcagggatgactacctaccgggagctgatagagcagctacgaaacaagccttctgacctgggcacgaaactacnagatcccccggatcatgaccactctcagcgtanctncttggggtcgatctgggcagtatggatgaggaggaananattgcaacaccttcaccaamammmmmtatyyaaaaarmaaaaaggggggrggttttttttgtgatccccaaaggggaaaaattttttggggggggggggccccccccctttttatgggggggaaaaaaggtttttttttggaaaaattgggggatttttttttttttttgcccctttttaagggggctaaaacaggtttcccccccccggtggttttttttttttttg

SEQ ID NO: 23304 - DNA, 945 bp, Homo sapiens
gaagggtcactgagcacttacatagrktaacagttacaagtttccataaatcagttagaatatgactagcttcagggaaggaattttcaacaactgcaatctttgattgttttactgtgggaacttgcagtgatataattgacaacattatttaacaataataggtaaagtaggccgggtgtggtggctcacgcctgtaatcctagcactttgggaggccgaggtgggtggatcacaaggtcaggagttcgagaccagcctggccaatatggtgaaaccccgtctcttctaaaaaaatacaaaaattagccgggtatggtggcgcatgcctgtagtcccagctactggggaggctgaggcaagagaattgcttgaactcgggaggcggaggtcgcagtgagccgagatcgtgccactgcactccagcctgggtgacagagtgagactttgtctcaaagaaaaaaaaacaataataggtaaagtatttaaggaattctcagatgccttatggacctcttcaaraatgtggttagccaattgattcaacttttataggtttatatgctctcatgtaaacctatttgtttccgagatcagacgagatcgggcgcgttcagggtggtatggccgtagacaacctatttgttaaaaacccttggaaacacatcttttagtaagaggttcttatttacttataaagattaataatcaaattactacaattaatatccatttagccttttcagtagtctaaatatttggtaactccctagccatctataacactagttcaaaacaaggctaattcataacctgtcttaaaaatgtttgaagkggtatcaarascattgkttatgccatgktgggatacttatttggggaactggttaatgagctttttaaactggttaaaaaatgaaataaaatggaaaatwctgkctaaaa

SEQ ID NO: 23305 - DNA, 1102 bp, Homo sapiens
  misc_feature 2, 9, 14, 979, 982, 1042: n = A,T,C or G
gnagacagnagggnatttattataatttgtttgactttattatagaattgactttccaagtgttcatgagaattattgagaattcgctacatagtatcatttcagttgtgtccacatgaattatcagtcaccttgtcttaatgaataatggttcactacaaatattggttttggcatttaaagtgatctatatctaaatgcagataggaccagggaccactcttgaacattaatgtccaagcatcttaaaattacacatgaggctttcataatctgacttctgccccactctccatckkkagcccttttccctgtgtgccctttctctgkcattrctgagctgctggtagtgccctactcactcatccttctrttgtaggcaaatactttcattctttcaggcctcgctcccgctcttgctgctrccgggcatgctgtcaccctttcctgccctctaccccttttaatctggccagcctcaatatttaagtctctgcttgggcatgtgttctagaaaagccatccctgagatgctttattttcattctttttagaccctaatgcctagcatgtatgtagcaggactcaatacaaattttctgagtaaaacaaagactgtttttacaaagatgatgtgcaagactctcccctgcagttttggagcagaggggacagacatatggagaaataatgtacagcttagggggtaaagatgccgtagaaaaatcagtaaaatactaaggcagcctcaaggaaggagatacctgtttatttggggaaagacatgcagaatcaaggaagacttcacatagaattgtttcaaaagatgaaaataaggctgggtgtggtggctcatgcctgtaatcccagcactttggaggctgaggtgggcggataatgaggtcaggagattgagaccatcctgtccaatggtgaaaccccatctctactaaaaatacaaaaattagctgggtgtggnggngcttgcctgtaatccagctactcaggagactgaggcaggagaatgcttgaacccaggagnggaggtgcatgagccgagatccaccattgcactccacctgggcacaagatgaactccgct

SEQ ID NO: 23306 - DNA, 623 bp, Homo sapiens
  misc_feature 537, 538, 541, 544, 545, 547, 550, 552, 553, 561, 569, 572,574, 576, 578, 580, 608, 618: n = A,T,C or G
gggaagctcttgaggccattcacctgccaacctgaccatactgctttcaaaagtcttttctcatcagtagaatctattttggtcacttctagtsrrtgaaaaatgtaaacttttaggagagaatgtttcctaggactcacccactccattcaatgttacatataaaatagtgtgatcaatcacaatgtccatctttagacagttggttaaataaattatctggtctttgaaaagaccgtgctgggcgcggtggctcttgcctgtaatcccagcactttgggaggctgaggcgggcagatcacctgagatcgggagtttgagaccaagcctgaccaatatggagaaaccctgtctctactaagaatacaaaattagctgggcatggtggtgcatgcctgtaatcccagctactygggaggccgaggcaggagaattgcttgaacccgggaggcagaggttgcagtgaggtgagatagcgccattgcactccagcctgggcaacaagagcaaaactctgtctcaaaaaaaaaaaaaaannganggnncnccnanngggcttangggaaaanatntntntnanatttggggggtttttaaaaacacaaaanttataaaatntggga

SEQ ID NO: 23307 - DNA, 929 bp, Homo sapiens
  misc_feature 649, 785, 791, 795, 806, 818, 855, 858, 869, 882, 912, 916,919, 920, 921, 923, 926, 927, 928: n = A,T,C or G
ggggttakaactatcttttgggaaaggatgccattcctaaaattaactcccttctggcaaatttctccctgccaggtacctaacctccccagcatgatgtttttctaccatttgccttttggattcctagaagtattttatttggatgtgactggtttgaatttggagcttttagagcaagacatttggaaagatagcatgtgagtgaatttatgtatggaatgaatgacatgtgagaaaactcttgttagacatgatgtttcctatacagaagaaaagatacaaacttgattgcttcagtaaaaacacttttagagattgtgtttccttttttgtgagacagcatctcgctccgccacatacactggagtgtagtggcacaatcttggcttactgcaacctctgcctcctgggttcaagtgattctcgtgccacagctacccgagtagctgggattrgatgcacccaccaccacacccagctaatttcgtatttttagtagagacggggttttaccrtgttgaccaggctggtctcgaacccctggcctcaagtgatccacctgccttggcctcccacagtgttgggattacaggtgttagccaccacgcctggcctagacatatttctaaagaaattaagatcttangctgaggtgggtggatcacaaggtcaggagatcgagaccatcctggctarcacggtgaaacccagtctctactaaaattacaaaaaaaattagccaggtgtgggggcgggtgcctgtgrtcccagctgcttgggangctgangcangaagatggcantgagccggaggnggagcttgcagtgagcccagatcacaccactgcactncancctggggacanagcaagactctgnctaaaaaaaaaaaaaaaaaaccctgggccntttnccnnnanccnnnt

SEQ ID NO: 23308 - DNA, 719 bp, Homo sapiens
  misc_feature 3: n = A,T,C or G
ggntttcrsgamarcakkgkaggacggcgggcttagccgtgggggggttctgcgccggatccgggagaggggcgggcgccattgtgcttcgctgccgactgcatttcctcagtcacgggcctagaactccaaggagaaaggcggcgaaaaatctttaagaatggagtctaaaccttcaaggattccaagaagaatttctgttcaaccttccagctccttaagtgctaggatgatgtctggaagcagaggaagtagtttaaatgatacctatcactcaagagactcttcatttagattggattctgaatatcagtctacatcagcatcagcatctgcgtcaccatttcaatctgcatggtatagtgaatctgagataactcagggagcacgctcaagatcgcagaaccagcaacgggatcatgattcaaaaagacctaaactttcctgtacaaactgtactacctcagctgggagaaatgttggaaatggtttaaacacattatcagattcatcttggaggcatagtcaagttcctagatcttcatcaatggtacttggatcatttggaacagacttaatgagagagaggagagatttggagagaaraacagattcctctattagtaatcttatggattatagtcaccgaagtggggatttcacmaccttcwtcatatgttcarracagagttccttcwtattcmcaaggagcaagaccc

SEQ ID NO: 23309 - DNA, 899 bp, Homo sapiens
  misc_feature 800, 843, 848, 859, 862, 864, 895, 896, 897: n = A,T,C or G
gggatttccaaagsggattcyttcatkkytrykaaatgarckwcwggtgakgcaaatkaaggctctcataaaacttgacctctgaggcaatattaaaatgatgaaatttaggcttagtgaattctactgttatcatgttcaataacatttaaggacataaaagaattttataaaaacattttatatattttaagattgaaaagtttaggcaaatgtaagggcagagcatcaccaaacattatagtgggaaaggatgtaagaaacaaagtctagtgacttcatttttaaataagcaaattgaggcacagggtagggcacaaaggttacacaaaccatattgaccaccatcgcagatcatccttagagacctagacgtgatagtctatctgaatttacaatctgaggcttcaatctttccactacaatcagggtctaagcaatgtttcctgaggagcaaattgccttgggctcattttttgagacttgttgaattgtagtccccttcatcagaatctcaaattcatatataaaggagtatcctgaaaacattgggttgttatcaaaagaggtttttttgggkgtttttttttggttttttggttttttggtttttaattttgtcctagtatcatgcctttgggtgagcaacgagtcctgtagaggaaatttatttgggtgacttaatttcttttgatgattacaaaggggcctaagacattaaaacttcagtagttaattgggcytccgactgtgaaaccgtaatctgacaaaccttrggggggggattcaactyccagggngggaccacccatggggcaaatgcactgtgccaggggcatttcntcaanaaaagtttccnagnanaaaaaaaaaaaaaaaaacccggggcgttttnnnaa

SEQ ID NO: 23310 - DNA, 995 bp, Homo sapiens
  misc_feature 764, 958, 969, 981: n = A,T,C or G
gggcagcatcggcatcaaccaccacctggctagaaacacaggccccactcccaaacgagttgaatcaggatctgcatttgaataaaatcccaacatgctttataccagacaggagttgacagtagtctaatagtagatgtagggatgtgtatgtatgaataagaaatkgwkttgmycyactwwccycmtgtktcytstttywtttssmyygcmtrskagaagattacatktggggagaagccacttcccctctctggatctctgtttcactacctatgaggagattaaactagactgtctataagagtccttctctgagttgttctctgatcttggattctaaaggctggcacttgtatgaaaccagctgtcctgctttctggaaaaagtccagcgccattgttaagcaggaaaatttctcctgtgtggttctgccaaaacaaaagctcagactattattcagatctggctgggcaagagagatttgtcaactacatgtttattgaatgatgaaacagctgcacacattcctgcacagaaaacacacattgtctaggtgacaaagagtaatgtggacacatcagggccatcttctgacctttgctagtttttttgttagtttgttttgkttttgtttctttgkattttttgkttgtttttgggtctgtttttgagacagggtctcattctgtcctccaggctggagtgcagcagyatgatcacggctcactgtagccttgacctcccagsctcaagcgatcctnccacctcagactcccaagtagctgggactacagtcatgcaccaccatgcccagctaawtttttttaaattttttgcaaracagggyctccttatgttgccaggctagtcttgaactcctggctcarcgatcctccccttggctcccaagttctgggatwtaggcatgaacwctgggccmgctaaaatttatttntcwttwacttngggggamctgtnacwaaamacccaac

SEQ ID NO: 23311 - DNA, 842 bp, Homo sapiens
  misc_feature 8, 17, 19, 22, 30, 797, 824, 831, 836: n = A,T,C or G
gcggcctncggctgcgngnagnacgacagnagggggcggtacgasagamggggacgtgcaggcagcggcggatcatattccttcatctaccatggctcagccgggaactctgaacctcaataacgaggttgtgaagatgagaaaagaagtgaagagaattcgagttttagttatccgaaaacttgtcaggagtgttggccgactgaagtcaaaaaagggtactgaagatgcactgttaaaaaaccaaagacgggcgcaaagattgcttgaagaaatccatgccatgaaggaattgaaacctgacatagtaactaaatctgctcttggtgatgatatcaactttgaaaaaatcttcaaaaagccagattctactgcaactgaaagagcaattgccagactagcagtacatcctcttctgaagaaaaagatagatgtgctaaaagctgctgtacaagcctttaaagaagcaagacaaaatgttgctgaagttgagtcatcaaagaatgcttcagaggacaatcattctgagaatactttgtattcaaatgataatggaagtaatttacagcgtgaagcaactgtcatcagtgagcaaaaagtcaaagaaaccaaaatattggcgaagaaaccaatacataattcaaaggaaaaaatagcaaagatggaacatggacctaaagcagtgactattgcaaattctcatcaaagccttcagaaaggattctgtagtttccttgagtccagaagacacctgctgaccmaactgaaactytagtcamccaaaaaaaaaaccctgngccgtttttcctaatccaactgaaaancttggtngttgncccccc

SEQ ID NO: 23312 - DNA, 846 bp, Homo sapiens
  misc_feature 1, 752, 820, 821, 833, 845: n = A,T,C or G
nacgacagtaggggtaaaagcttgacttgtgccctttttttttggctgaaaatgggggatgaaatcaaggrkatattgattttaattatttgctaaagacatatttattgaatatttatggagagccagtgccaagaattctgagggatatgaaaatgcttgttagtaggctaccatgggaacttagtttagtaggtgagaaagtcttgaatgtgaatagctgaacaagtaatacaagttggcagtattttatgggtgttacaagtgatgacttaggttcaaaggaataagcagttatttctagctggaggaatcagaaggcttcatggatgtaggacttgaaaggcatcttatggacatattagtagaagatgtactaattggagcaaacaacactgggaaagtcctgatgatttaaagcttctctgatgtatcttaattttattacataaccgatgtttaacaaatgattggattattaatattaccattttttggtcttaaaaagaatattgttgtgttagatgattcagcatagtattgtagttctcaaagtgtgatccttggcagcatcaacatctcctgctaacttgttggaaatgcagattcttggctgaatcccatatctagccgttgagtcagaaagtggtgtgggattcagcaccctgtgctttaacaggtcttattttgacagagccacttctacttaatgactacctttttaaaatgcggaactgatgctcactttggcncmctwtgttaaattggatgatmcaaaataacatgtccctgcccagggtaccccagtttmcaarggttnntatttttattcncctgctgcctgnt

SEQ ID NO: 23313 - DNA, 1308 bp, Homo sapiens
  misc_feature 1, 17, 19, 22, 49, 1306: n = A,T,C or G
ntggcctacggctgcgngnagnacgacagtaggggattttcaacccctntttatggttaatacagcgtatttagtggaaaagsatgtaagacacaggttaaaaactattagaaagggttaagaagttcaatactgagtcataaagtaaactaaaattaaagttcaaacttcataaaatatgaaatccctttagctaacataagatcatgtaaccaaaaacattacatatgywwataacatcagtcaatataataaaagatgaatcctactaaaacttttatgttgcccagtccaaataattgtttttctacctaactgatttgtgttcatactgatcmctatatcccaataagtatacattaatcttattaatttaatatttatgacttgagtgactgctatccatctagaacacacagattaaaagaaagaactataccttccatatctatccagtgcatttaaatttgcttttttcttgattaaaaatttcaccacttgctgtttttgctcatgtacaccaagtaacagtggtgtgaggccatgctgtaaaacaatataaagcaaaaacgtatgtattcaaaaaagtacatattcctcaaccgaagtggaaactttatataagatcttatggacttacatgcatagaaagtaaataaaatgtagtcgcttccttctcactcttctgtgctttcccacacgctgctccttcccttggaaacaccccttctctgcctcaccacagtaactctactcatctcaaaaactcactttaaacatttactgcttccaaggctctttgcttctaacccagcatttgatatggtattattggatggtaatatttttcccatctaaacaaagagctccttgagggcaggggytgtatcttttgtttctatatcctcaaccctaagataaattgcgtataaagcaagaatttgcatgtaaaatatttctttagyttcatgttttactgaaagttcaacctccaacatgcaacaaaaattgctattaaaactcacactgcccatctgaaaaaattttccaacatttatttatttaaaatctatttatatttaatytttcccagattgktactaaaataatcagttcataggactacygaaactaaawtaacagaawtcctatctgcattcttaataactcmwkggttttaagtggggaaaactggccatgctgattatgccaaagctctacatwcttaaagagacacactggmcagtccacaatacagcttcaattgataaaaaacaagttaaaaatttgcttaattccaattggnaa

SEQ ID NO: 23314 - DNA, 875 bp, Homo sapiens
  misc_feature 866: n = A,T,C or G
aggggagttgtaacttgcctggtgcccaatagatgtcactctgttttcctagaaactttaaaatatccctcagtrckmcwgttarkksatggtagtgccccaaggcactctggcacccagttttggaactgcagttttaaaagtcgtaaattgaatgaaaatgatagcaaaggtggaggtttttaaagagctatttataggtccctggacagcatcttttttcaattaggcagcaacctttttgccctatgccgtaacctgtgtctgcaacttcctctaattgggaaatagttaagcagattcatagagctgaatgataaaattgtactacgagatgcactgggactcaacgtgaccttatcaagtgagatggagtcttgccctgtctccaaggctggagcccaatggtgtgatcttggctcactgcaacctccacctcccaggttcaaacgtttctcctgcctcagcctcccaagtaactgggattacaggtacccaccaccatgcccagctaattttttgtatttttagtagagatggggtttcaccatggtggccaggcttagtctcaaactcctggcctcatgtctgcctgccttggcctcccaaagtgctgaaattacaggtgtgagccactgtgcccggccaacatttcttaacctagtagtttagtttttatagttttattaccgcagtgaacgctacaccaaaaatttcatttgaatattaacataaaagaataattttgkattaaacttttaactgaattttcatagcattcacaatctwttaaatgtttcaccttttacagaataaacttcatgagctttatttgtaacatttattgtcccacatataaagcctgnaagtataac

SEQ ID NO: 23315 - DNA, 975 bp, Homo sapiens
  misc_feature 4, 242, 265, 808, 841, 858, 885, 902, 916, 919, 934, 938,948, 967: n = A,T,C or G
gggnattatcactcatctttctatgtgcacatgtgttatttccatatccagagggcacagcatgcataaatgcatttattgggcatctactatgcactcggtatgtgatggacagttccacacaatattatttgtgttattccctcacaatagcctggtacagggttatctccttttaatagatgacaaaactgaagccaggaggtgtgcattgctgttttttttttttattcttgcctagngtttccattgatttctccctganagttttgtaagcctccttctacatctttaactactwkkatttcctgtgggattgtctctgctgtccctgacaaaggctctaracaatgggcatgtcaggactggctggattccaccaattcccaracacaagtattttttctcctccatagtttggttcacttaatggccattgcttcctcattttcttgccaagkgacccctccaaccaatggcctcctctctaggctggttggtgatcaacacacccttaragaataaccagcacattcagtctctgggcagatgtgcctctgagtgtgtttcccactggggtaragtggaaggttgtattcctararacaaactcatgtcccaaagaccttgagtttgctttttctcaaggkgccatgarttatttatttattataggccaamaaaaaatgtgagcatggtactggtacaaaaatagatacacagatcaatagaacaaatagagaacccagaaataaagccacatacctacagtcaacttatcttcaacaaagtaaaaaaaaaaaaacantggggaaaggacagccttttaaataaaatggtnctgggaaaattggctantctttgcaaaaaaaaaaaactgacttntaaactttccccatgcncaaaattactcaanaanattaagggctaaatntaanacctggcctntaaatcctaaaaaaacttnggaaactt

SEQ ID NO: 23316 - DNA, 997 bp, Homo sapiens
  misc_feature 160, 802, 829, 832, 861, 866, 875, 876, 879, 900, 912, 917,934, 987, 996: n = A,T,C or G
tgtgcgtgtggttggaagattacatggggaacagtgtgtgtgtggagggtttgatggaggacaggttattccctcagtgcctcttgacaccttccatgtggcctagtagaaatagaactttttccttggttcttagacattttaatgaataataatggcngctaattcttaggaacatattaagggctaaatwgawyttrkgctaktwtatawwyyymccytmtttratsctaaaatatattctgtggaatmmryacyackrkcatttttattttacaggattaggaaacagttgtagagggtacatggcacatcttgagttacacagccattaaccagtgaaacggggattacagcctggggatctgaattccaaaggccagagtattaagcagtatgctattatcactcatctttctatgtgcacatgtgttatttccatatccagagggcacagcatgcataaatgcatttattgggcatctactatgcactcggtatgtgatggacagttccacacaatattatttgtgttattycctcacaatagcctggtacagggktatctycttttaatagatgacaaaactgaagccaggaggtgtgcattgctggttttttttttattcttgcctaagggttccattgatttctccctgaagtttggaagccccttctacatctttaactacttttattttcctgggggatgggctctgctgccctgacaaaggctctaaacaatgggcatgtcaaggactggctggattcccmattcmmamamcaaagatttttttctccnccaagttgggtcacttaaaggccatgnttnctcattttttgccaggaccctccaccaanggccnccctttggnnggnggggacaccccccctaaaaanaccacccttcanccttnggcaaaggcccttgagnggttcccctgggaaaaggaaggtgtttcctaaaaaaacttttccaaaacttanttttttttna

SEQ ID NO: 23317 - DNA, 958 bp, Homo sapiens
  misc_feature 2, 9, 13, 15, 18, 19, 20, 24, 31, 42, 44, 51, 61, 64, 72,81, 83, 947, 950, 951, 952, 953, 954: n = A,T,C or G
anatcttgncctncnaannncttntttgttncttttggccgnancggcctncggctgcganagnacgacagnagggggagnanaaacctcacatstgtgatgaymktsgcwaagccttswcttcrywcctywtgagmcrtmasrgmmtgcakrctgcgacagaarwcttasaarkgtcaysrmtsygcmaargwckwcagtmwgrgttcactccttgcagaatatgagaaaattcattttggaggtagttggtccatatgcaatgagtagagcaaaccatcaagcattaattgacattagggtcaattcagcattgacttgagtttgtattgacttaacattgagttcaagcattaattgacattagtgtttatgttaagaggattgggccaggcacatcagcttacacctgtaatctgagcgctttgggaggccaaggtgggtagatcacttgaggtcaggagtttgagatcagcctggccaacagacgtgagccattttcccagcctgttttttgtttctttaaaaaaactgatagggatttttatggatatcatgttgaatctaaatcacattgggttattatataatcatttcacaatattaatttttccaagctatcaatatgggttgtagctcaatgtttttaatcattttgatcaatgtttgtagatttcaaggtacaaacttctgacctttgtacgtttatttctaagtatttctttaagttctccagcaaatggaagtgttttaaaattttcttttaaaattgttwatkgtaaagtatggaaattcaactaatttttggtgctgatactggattgkgcaaatcactgacttgtacttarttcagtagattttgggtggctctttgtgatttctaccaaaaratatgtatctacaacaatwtaatttacttctdactttmwraaaaaaaacccrggccnttnnnnnatca

SEQ ID NO: 23318 - DNA, 1349 bp, Homo sapiens
  misc_feature 765, 768, 781, 782, 811, 848, 857, 861, 888, 903, 924, 929,930, 938, 940, 942, 956, 960, 961, 966, 978, 990, 994, 1076,1078, 1090, 1094, 1101, 1129, 1148, 1183, 1184, 1187, 1196,1214, 1250, 1260, 1273, 1290, 1291, 1305, 1308, 1312: n = A,T,C or G
  misc_feature 1326, 1331, 1333, 1335, 1338: n = A,T,C or G
ggggcatttcaactttggaaggaagcaaackasrsaaggrgatactcatttcaaagaacttccaactcttctccactgtgcagcaaaatttggcttaaagaacctggctattcatttgcttcaatgttcaggagcaacctgggcatctaagatgaaaaatatggagggttcagaccccacacatattgctgaaaggcatggtcacaaagaactcaagaaaatcttcgaagacttttcaatccaagaaattgacataaataatgagcaagaaaatgattatgaagaggatattgcctcattttccacatatattccttccacacagaacccagcatttcatcatgaaagcaggaagacatacgggcagagtgcagatggagctgaggcaaatgaaatggaaggggaaggaaaacagaatggatcaggcatggagaccaaacacagcccactagaggttggcagtgagagttctgaagaccagtatgatgacttgtatgtgttcattcctggtgctgatccagaaaataattcacaagagccactcatgagcagcagacctcctctccccccgccgcgacctgtagctaatgccttccractggaaagacctcacttcamcttaccagggacaatggtggaaggccaatggaaagaagtcaaactggggtcttcctggtgttagacagaaacaggagatgaccccaaggagaaaaaaaaaaaaaawwytttttttttttttttggggccaaacccctttaaaaaccnggntttttaaaaaaannaaaaaaccccttggggtaccctttgttangggttaatttaaacctttttttttttttggggggggnccccccccncggnaaaaaaaaaaccccgggggcccccccntttaaaaaggggggnccctttgggggccccgggggnaaaannaaaaaaancnanaccccaaaaacccnaagnnaaaangggggggggggnaaaaaacctttncccnaattttttttccccaaaaaaaaaaaaaaaaaaacctttttttccccccaaaaaactttttccttttttttccttttcccccnanacttttgggggngggncccaaancccaaaaaaaaaatttttgggggggggncccttttttaaaaaaaaanaaaaaaaaaaaaccccccccggggggggccctttnnaanattttcccncaaatttttttggggggngccccctttttttccaaaaaaaaaagggggttttcnccccaaaagnggggggaaaaacncccccaaaaaccccccnnggggggggggcccnatntttntttaaaaaaaaagnaaaanangnggngaaaaaaaaaa

SEQ ID NO: 23319 - DNA, 958 bp, Homo sapiens
  misc_feature 2, 9, 914, 947, 954, 957: n = A,T,C or G
gnagacagnaggggttttctgtgtgtttctccattatgttgttgcatttttctctatttacgttatctccctttccctttttctctctgtccctccctccttctwcywmwctatkstkcsmywmmccttgytttkwtgcytgattrksyggacacacgacaaggattaaaacagggcacctgcccttgaggagtttacaatctgctgggctgaggatcaacacatgttcaaaaagagaggaaagaagtcaagggagatcatgccagatggacttaatttcaatgaagaacagggtcttcctgcctgtaagaaggaggcactctctgcttctgtcatgtgctaagcttcgtcaaacagattatctctctaaaggtagaggcctgtgattgaccgctgtaccaatgactgagcagacataaaagtcagcctggatggctaccaccactaatcagatttgtctgctgatgcaaggcccttcagtcattccagaactggtaaatggagtcaccctgaggacaggccctgctgctgattgatgtccagtgtgggcagctctcttggctgctcaacattcagagaggctctccttgtttcagtgctaaatgattgacagtcagggtgagtatttcaggaggaagagtcccccgcccactccagccatgtggcaaaggtatttgcttccttgggaaggaagtgatttatctgtgggagaacactgtttgggcaaagttgcgtaggaacagcgtctgtctctgcaagcatgtgtgtatgtgagtgtgggcataaagcagcaagagtggaaggtaaagacaacgtgaacgtcataaaagaacacttctttttacaaatgcttgaaacttcgatgctgaaagacttcagacccctaaatgaatttgcacctaattcacatggcntacttcttttttttcaaattaagagcctgcctntcattanttnt

SEQ ID NO: 23320 - DNA, 1088 bp, Homo sapiens
  misc_feature 5, 6, 11, 13, 17, 18, 19, 24, 30, 41, 43, 50, 61, 63, 64,71, 73, 77, 963: n = A,T,C or G
taacnnggttncnatannncttgnttgttncttttggccgnancggcctncggctgcgagnanncgacagnangggnaaagtcaggtacgtcttcattgattttacatcccagcacctagcagcacatatgacagaacaggtgaggtgctcaaaaagaattttttgtttcgaccatctataaagttgaatgtaagaggccatggaatgacctgtttgttcatctcattgattcattaagacatggaatgtaaaaggccatggaatgaccatctactgaaactaaaattagacattttaccataattatttttaaaccactataagtagatattggttaaaaactttattattgataaactcatgctgggkgagttttttaaaaactttctttcataaagtcacaagaaaaattgctatatttgaagatcttcattgtatatttatacaagttagcaaatgctgcctaacaaaccacctcaaaggtaattgcctaaaacaacacacgttattactcttgagtttgtgtatcagcagaatgactcctcctgtctcagtttgccttcattgtgtatctggagtcagctgtgcatcagtcagtcaactctgttgactgcaaatttctcttgaatggactcatctgtactctcctctatacattgtctgattttccagaaggctacacagggcttttgacatagcaatgactgggttcccatggaagtgagcagaagcactcatgaggcccaaactcagaaccagtggcattgccatttccatcatattctcttagccaatgtaaattgcaaggccacattcargagatagaggaacaaactcccttgcttgatggaaaaggcagccaagtggttttgcaaagggtctaggtacaggggaagagtgaagaatggtggctattttggcattagctcttcaagtttctaattttgaaactatttatcaangctagggtgtggtggctcatgcctgtaatcccwgcactttgagaggctgaggtggatcacttgaggtcaggggttcaagaccagcctggccaacatggcaaaacactgtctctactaaaaatacc

SEQ ID NO: 23321 - DNA, 966 bp, Homo sapiens
  misc_feature 552, 627, 732, 814, 855, 858, 910, 916, 917, 934: n = A,T,C or G
gggggaaaagccagtcagtgaagcagttagagaatacacattattcattgattaagttcgccgtcctatatgggcatggtttgtggcataccaaaacaattacaacagtagcatctgagatcactgatcacatatcaccctaacaaatataataacaatgaaaaattttaaatattataagaattaccaaaatgtgacagagacatgaaatgagcacacattgkkggaaaaatggtgctgatagacttgctcaaccagggttgccacaaacctgtgatgtgtaacaaaacacagtatccgcaaagtgcaataaagcaaagtgcaataaaacagataagggctggaggctctggagttgaaagccctctacatggcagatgatcattgaagacatgtgatgtatgcagtcactaagagagaagctgtagaagaaaaagctgagtgttggagaatgttgcctatggggtatgaagatgaaggggagctggtgactgagactgggtaggagcagtcagagaggtaggagacagaacaggagggggtggagtgaangaaaggaaraaaagtaagggcttaagaargacttggccattctttacacmaacaaggcagacaaattcagagcanagacctgggatagtgatgagtgggtttcttagtgaccatagtgagaatggktcattggcttggtgaggacagatgcttatttatggggctcaggaaaatgggaanaaagacatggattttataaatgkgtgctattccctttaaccattggccataaaagraggaaaactttgaargaacagggtanagaaatgatctgtctccaaagaagcaattgttttggtcatncangaagtaaaagccaaagcttgaaatgcaggaaatggtggggacaatgggaaancttgcnnggataaaatcctgagcntgctgagggattgtctcagaaaaataaaaacc

SEQ ID NO: 23322 - DNA, 851 bp, Homo sapiens
  misc_feature 4, 11, 14, 18, 19, 30, 41, 43, 50, 60, 70, 773, 808, 826,835, 838: n = A,T,C or G
attntttggtncgntaanncttgcttgttncttttggccgnancggcctncggctgcganagtcgacagnaggggttgcctatggggtatgaaggatgaaggggagctggtgactgagactgggtaggagcagtcagagaggtaggagacagaacaggagggggtggagtgaaggaaaggaagaaaagtaagggcttaagaaggacttggccattctttacacaaacaaggcagacaaattcagagcagagacctgggatagtgatgagtgggtttcttagtgaccatagtgagartggttcattggcttggtgaggacagatgcttatttatggggctcaggaagaatgggaagaaagacgtggattttataaatgtgtgctattcccttaagcagattggcaataaaaggaaggaaaactttgaaagaaacagggtaaagaaatgatctgtctccaaaagaggcaattgtcttggtcatccaggaggtaaaggcaaaggcttgaagatgcaggaaatggtggggacgatggagagagctggcagggatagaatcaggagcatggctggagggattggtctcaggaagaaatagagacactgcttcaagattggagggaaggctgggcacagtgggtggctcatgcctgtagtcccasmawttttggaggctgaagtaggaggattgcttgagtccaggagttcaagatcascykggcmacatagtaagatccccatctttgcaaaaarraaaaaarwwrccacctggggcncwtktttatcttcccctcttaaaagtaccctgctnttaaaaaaactgaggcanaaaaaactngtngataccttaactt

SEQ ID NO: 23323 - DNA, 1051 bp, Homo sapiens
  misc_feature 181, 192, 209, 926, 948, 1019, 1026, 1044, 1049: n = A,T,C or G
ccttcagggggctgataacctagtaaatcatcaaaatgaggatcataagtgttaatgtacactggacatgaaaacaaagactggtttagcagcagacattggtttactctgcagcctgtgttttctgtttccccctttcccacctccttccccccacccaatccttttttttttctttttngcttttctttnctttttttttagttttnatttactttacctagtatgcctttttttagtkgckwcwsaagksaraaaacttttcaggaggtttccctgtgcatttgcaccagratgaatgtttgatgctatgaaaagctttccatatcatcaaaactaatttgtgtagatttttgcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagttcatttttagattttgttgagtcctgtaaagaagaagaagaaaaaagtttcagttgtggtagaataccgtgctgtgtttaaatgttacttgttttcaaactttgttttctatgaaaatgatatggaaacttctaaaatggaatttggtgcatatstactgctgaataaagaccgatgaagaggtttgagtagatgtacaaatcaagtaatggtttgaacacctttaataatatgcctaatctgttcaattgttttagaatctttttatcttagatgtaggcagccatgaacaatctattttgagycactttagggagaaactttgtatttttaaaacttgcataaaaggtatgccagtgggttttataattggaataatacctcagttttgaggtatgcccactaattaaatgngcataaataatttgkccaaaanactcttttaaggggctcattgrrgaaayctgcgccttccyttrmccmagggkgmtgaaaacagttgcttanaaacctnccgatagccccttagctnttttntc

SEQ ID NO: 23324 - DNA, 1258 bp, Homo sapiens
  misc_feature 3, 10, 14, 31, 46, 77, 1189, 1207, 1216, 1231, 1237, 1239: n = A,T,C or G
ttntttgggngtanaaaacccccttttttgntgcttttggccgccngggggtgcttccggtctccaataccgcaggnagggcggtcttccccggctcgccaactcggctgctctgggggattcgtgcgcggtaccactgatgaaattatgaccaggtgggcccgagttagtaccacatataacaagagacccttgcctgcaacatcatgggaggacatgaagaagggatcctttgagggaacaagccaaaacctgccgaagcgtaaacaacttgaagccaataggctatccctcaaaaatgatgcaccccaagcaaaacataaaaagaacaaaaasrrmamragagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataaccaagtgtaaggctaaagtagacccggctcttggcgaatttccttttgcaaaatgttttgtttgtggagaaatggggcacctgtctagatcttgtcctgataatcccaaaggactctatgctgatggtggcggttgcaaactttgtggctctgtggaacatttaaagaaagattgccctgaaagtcagaattcagagcgaatggtcacagttggtcgctgggcaaagggaatgagtgcagactatgaagaaattttggatgtacctaaaccgcaaaaacccaaaacaaaaatacctaaagttgttaatttttgataacagctagcactatcatgagttactacctcattgktactttctaaaccaggcccgcttcacgagttagagttgagctcccctgtagccaggactatgctgtaatatcagtatgatctgggtgtggccaaaacaattttctttattctgkctatcaaatagtacttctccactggttggagaaattgagaaaraatagatgattaatgattctttaaaaacatntttaaaacaagaacttanactaccagnagtggttcctgttgnacatcntnttttaagcaaaaatgctaa

SEQ ID NO: 23325 - DNA, 878 bp, Homo sapiens
  misc_feature 1, 9, 26, 765, 786, 799, 832, 833, 852, 855: n = A,T,C or G
nacgacagnaaggggagatccactgnattgcaatgcaatgggacaatatctggaagcaattttatccagaaaaatcaatagctttaaaacaattcacaaccttggacctaatacctctacttctaggaagctagcckrkgaaggyttctgctgaaggatgtttatcacagtattatttataatgtgaaaaagccaaagaggagacctaaaatgtttcaaagatgaaaatggtttgataaaattattttttttttgagacaaggtctcactcttgcccaggctggggtgcagtggtgcaatctcggcttaccacaacctccaccttccagattcaagcacttctcctgcctcagcctcccaagtrgctgggaatgcgggcacaccccaccatgcctggctatttttttgtattttagtrgrgatggggtttcaccgtgttggctrggctggtgtcaaactcctgagctcrggcaatccaccttcctcagattcccaaaatgctgggattrcaggtgtgagccaccgtgcctggcgataaacaacatatttaaactctaaaatgttatgcaagcattccaggcatgcttttggaaaaactattaatcccmcaaaagatgcttatgtaattatatagactaacagaccaagattctccaggacacttactttgttaartgtctgaagtaaaatgyaatgctgtatataaaatgtgacctgaagtcaggtcccagtcttttcatctggaaaatctggtaattatactgnccttcccttataggtttctgnaggagttaaaacnctttttcaattgcttgaatatgctaacactggnngggagctaaaagtcagctntgncctatgggccaaaaaaaaaaaaa

SEQ ID NO: 23326 - DNA, 922 bp, Homo sapiens
  misc_feature 2, 12, 15, 17, 21, 22, 35, 71, 860: n = A,T,C or G
antaaacttggntcnanaaannctcggcttttttncttttgggccgcagcggcctacggcctgcgaggagnacgacagtaagggggtgacaaaacctataaaatattttctacacgaaatacattacattagaataaaagtctgtggawaygamartaagrgctcarmkgmgcaaaaarawygayrtsarrktwcagactrytaaagtacaacagtmwgtkkatagcaattggacacctgatagcatataatattcatactctattgcagccatcccttcctttttggcactagggaccagttttgtggaagacaattattccatggatggagggagtgggggctgttcggggagatggtttcaggtgaaactattctacctgagatcatcaggcattagttagattctcataagaagtgcgcaaccgagatttcatgcgccgcccacaatagggttcacgctcctatgagaatctaatgccgctgctgagctgacaggaggcagagctcaggcagtaatgctcgtggcccactactgctcacctccttctgtgcggtctggttcctaacaggccacaaactggtactggtccatgactcggtggttggggactcttgctctattcaatacgcttaaaagaatgatgttggccaggckcggtggctcactcctatratcccaccactttgggagtttgaggtgggcagattacsaggtcaagagatcsasaccattctggccaacatggtgaaaccccatctctactaaaaatwcaaaaaattagatgggccgtggtggcscacacctgtagtcccagctactcaggaggctgargcaggaraatcgcttgaacccgaangcagaggttgcagtagcagagattgctcactacacttcatctgtgacagaccagactcatcc

SEQ ID NO: 23327 - DNA, 1074 bp, Homo sapiens
  misc_feature 1064, 1068: n = A,T,C or G
agcttatgatataatttcatctcatccatcaataaataagaacacacaggtgtcattctccccaaatgagaaatggaaaaattgaggctctgtaaggttcagtaccttgcttagtgttacctaaataatcagcggttacatcaaaaccagaactaagtttgatgtctagaagctacagaatataattttcaggaccaagtggaacaagkkatgttcagtttgattttaatgcatttcagaatctggacaacatcytacaaaatgkctgmkwawrtcckattttttcwgtagattkstagaaagggaattacaattgggggtgcagggtaaatctattttctgacagtggtatgcctttgctcttacaatcttatcagctgaattgagggaaaattcatattccatgtcaaattcatgtaaggcgggtaatgtccggttgcagtatattcacaaaatatactttcttgctgtgtgttcataaagtcctacttcacagccacaaggtttgtagatctttgacacaagagaagtggcagcaacaactccaaaggggactgtgtcctttgttgtctaagagtggcttctaggtgagctttgaatcccattgtgagaattccaggagtgtggaacaaaataggaaagctatagactgagcagacgatgtagtggtctaagtaaaatgtagttagtctttcatttctcttcattttaccctctatcatgccgtagtgagacagaagagctgatttaaatagtgaaagaattcttctaaacttcatctacttgtgtgttcaacagggctggagggaggctwtaaagaaagtcatggaacagagctatacttgtgcttggttcatgccttgagcaratartctttggggcattccatgggagatgccctaagatcagcccgaacaagtgatgttgagtgagaaggaragacagggggkgtcaccaragaaggacctggaggaagggatattttcctgaaggctccccccccccgagtaaaaaaaaaaaaaaaaaaaaaccctgggccgtttactaacccaataaaacttggngtgncccccc

SEQ ID NO: 23328 - DNA, 1318 bp, Homo sapiens
  misc_feature 2, 3, 12, 15, 19, 20, 31, 44, 51, 61, 64, 71, 73, 98, 172,1207, 1212, 1252, 1264, 1277, 1278, 1282, 1286, 1287, 1296,1299, 1300, 1302, 1305: n = A,T,C or G
tnntttggcctncgntganncttgcttggtncttttggcgcgancggcctncggctgcganagncgacagnanggggtaaaggatggaggatttaacnagtactgtgacagaacaaagtactgtaagtactagagttgagtgtggatggaaacacaggaacctgtaaatcangtgtttcgtttacgtgctcaactcctactgaattttagcaattaaaacatgaaaactgaaatattggttagcaaatgaaaatrgmaykwraagacctgaacttcttttatgatctttaatsattatttgttctaatctttgacttggaaacccaaattattttcagtctaacgtacttgaaatttaactattaaaaaagttggaggaactcaaactttgaagttagggctccctttctccagataaagcacattgcctggtttattgtaaggcacttagaacakgtaaccaaaaacactcaatttaggaataggaatgattgttttacagctaagtgcgctctcagagtcttttgttttacacccctctcaagtttacctttagatatttttcttgttgtttaatattttgtgacaratttggcaacttttaaaaagttgtttgaattgaatagtgcataaaattaatagatgtttttcagaaaatccattattaagagtagaggaatgaggagaaatattcgttctaaagagaatcaaaaccacaatgagagattgtcttacccccgttagaatgacagttaccaaaagacagtaacaaatgctgacgagaatgcagaggcaaaggaacgtttaaacactgttagtgggaatgtagacttgtacaaccgttatggagaagagtatggaggttcctgaacaaactaaaaatagaactaccatatgattcagcagtcccactactgggtatatatccaaaagaaaatccatatatggagacatctgcacctgccatgctcgttccagcactattcacagtaccgaagattggaatcaacctgtgtctatcagcaaatgaacagataaaatgtggtatatataccccgtggaatactatttggccattaaaaaaacaaaattctgttattctcagcaacatgtatgatcttagaagacattatgttaagtaagccaggcacagaaagataaatactccatgtactgtacttatgtggaaggtaaaaagatctcttanagtanagagtggctcatgcctctatctcgggctttaggagtctangggggaggatcncttgaggcctggnnttgnaccnnctgaccacntcnntnaantaaaaaaaaaaaa

SEQ ID NO: 23329 - DNA, 1145 bp, Homo sapiens
  misc_feature 986, 992, 998, 1028, 1055, 1086, 1087, 1093, 1126, 1138: n = A,T,C or G
gggactctaccgagttttaatttgtcactagtttaaagggccaaaagatctgttttcttcagatattagagacacaaaccaagcatctcccactttcttggaattccttctcaaaaatgactaaagtctgagactgttttcttatttaatgtctattgaattctgttttacagaatttcaaaagagcaggkagcttacttttcaatggaacattttagccaggtagtataagtacaggtgcgggtaacctcagataaatcaaggtgttatgcagctgtctctatattaaaaatatttgctgacatcagtgtagacttcatcttgtagttcttcagtgttttctttccttatcttttgctcataagatggctttgtgtttggtttgatattatactgagaaagcatattagaatcaaagcaccaagatttcaaaagtccagactactcttcccaaagagaaatgtgcaatcacaatagcatgacatgggtacaaatatagaagtatgttattaaagtattgagaattagctttcctaacctccccacctgcaatcttttactcctaatctccaaaaaatgaacaaatcattggctcaaaatggtcacaaattgtatgtggtgttaaaaatctattatttttattgtatataaaatgttgccaggtgtggtggctcatgcctgtaatcccagcactttgggaggccaaggcaggtggatcactaggtcaggagttcaagaccagcctggccaacatggtgaaaccccatctctactaaaaatcmaagattagctgggtgtggkggcgtgtgcctgtaatcccagcttctcgggaggctgaggcatgagaatcacttgacctgggaggcagaggctacagcgagccaagatgggccattgcactcagcctakaygacagachagactcatctmraaaaaaaaaaaagcytwtactagyyggkmamkkkggctcaacctgtaatcccacnctttgnaggccnaggcaagggacccctgagtcaggagtcaanaccacctggccacatgggaaactcctntttctaaaaaaaaaatactggcgggggcaanncctgtntcccacttcttagggggtgagcagaaaatgctnacctggatcccntgcctcc

SEQ ID NO: 23330 - DNA, 1036 bp, Homo sapiens
  misc_feature 2, 9, 51, 968, 976, 980, 981, 982, 986, 988, 1015, 1018,1025, 1034: n = A,T,C or G
gncgacagnagggataaagtatttttagtaatttaaacgttatataacagnatatccgttgattcctttgtttctacgtaaataagtatacttgagatattcagtaaacagtattgaatacatgtttcatttgtataatataaaattatgattattctttttaaacagtacatcatatttgcttgttggctttatgataacttagaaataatattckgsmttrrctgygwgacwsaygagmagatttgggtatgtttccaaatttacttgattttcaagacttacactagaactgtgagaacagggtaataaataagcatatgtattaatatcacctttggtcaactcttgggtagccccaacggtagtgtaggaattaacgtaatttttcctactaaaagtattggatttgttttgagagaccacagttgaaaatcattgacatacaaagtttaaaaattgttaggttaaaaaattttaaatgcatttgaagtggttttatagaaaaataattatctaacttggtttatattgacaggttgttttcttggataagaactagacgaagagaaagggagattagtgataaatgtccaggttttcaagttgaaaagtaacaatcagtgtattacaacagatggatgtgatgtcaaattacaaatgctgaaaacgttatatgtaatcatgtagccagagtaatcatacaaggcaaagaacggaaaggcatccaaataggaaagaggctggagtgcagtggcaccatctcggctcactgcaacctccgccttcgggttcaagtgctgctcctgcctcagtctcccargtggctggactgcaggtgcgtgccrccgcgcccggctgattttgtattttttagtggagacggggttcrccrkgtkgccgggctgkctcaactccgatctcgtgatcamcacttcggctccaarggccgggatgcrgcgtgrccncsggccancatnnnaatntntaaactcaaaaaaaaaaaacctgggcnttnctatcantaaaattgncc

SEQ ID NO: 23331 - DNA, 1061 bp, Homo sapiens
  misc_feature 771, 913, 936, 953, 958, 984, 985, 995, 997, 1026, 1029,1032, 1033, 1038, 1040, 1055: n = A,T,C or G
tttttwggskacrayaaagctkgcwtgttcttttggmcgatgcrgcctcrgmtgcgagtagackacmkgmrrrtaggcgcatatttttttaaagtacagtagttagttccaaatatattattttatggatgaacaatttaatctaaaggggactatatcaggatattggaatcacttattggaccgtaagaattgaaacctagatcaaataaatttgagtagaaggaaaaggtaagagaatgacacaaaaagcacccagaggagagtatttctgtgtaaacaggtaaattaataggtggatatttaatacacaaattcacatttgtttcaagattggccttgtgtgtatggatactaaaaaggaaataacactaatgcttcattcatttttttattccaaataattttgctaagccccattacatagccaactcactgttagacactttgttttaaaggtgaaagagttaatacatttgcttccaaagaacttactagtaaagttacacacacacacacacacacactcacacacacacacatacacacacagagaatgagagagagaattacgtattctataggaaataaaggtaatatagaaaatctaaactaccattcaactgtaaattttttaaaaaggaggtattttacttatacaattttgagtgataaaaaargaacatcttcaaataatgagtctaaaagaataatgcaggttgtccgggtgtggdggctcacgcctggaatcccacactttgggaggctgangcgggccggatcacgaagkcaggggatcgagaccmtcctggctaatacagtgaaaccccmtctctactaaaatagaaaaaattaggcaggcgtgggggsgggcaccctgtaktcccagctactcaggaggctgaggcagganaatgcatgaaacccgggaggcanagcttgcagtgacccanatacncactgccctccagtctggcgggaaannaagactccgntnttaaaaaaaaaaaaaaaaaaaaagggccnttnccnnacccnanaaaaacttggggtgncccccc

SEQ ID NO: 23332 - DNA, 1019 bp, Homo sapiens
  misc_feature 12, 19, 20, 22, 23, 29, 31, 73, 80, 85, 680, 901, 912, 918,924, 926, 950, 957, 988, 1006, 1015, 1019: n = A,T,C or G
ttttaaaaggantaaacgnngnnaaaaancncctctcttggggcttttggaacgccccggcctaggctgcganagttttnggganggggaaattcatagggaasgcctccatgbaggaaacttgggcaggatttctatattacaatattgaggcagaattccttcttcaaaaacatgtttttgcttttaaggccttgagctggtgggatgagagccagccatgttatccagggtactttccctttacttaaagtcagctgattgtcaattgttaatcatctctacaaaaccttcacagtgccacctcgattagtatttgaccaactaactaggcatcattatgtagccaagctgacacataaaaattaagcacccctaggtgaaaaggtactgcctgcagcagaagagggtgtgaggggcacagagccccctcctggtcatgaaacattgaagtcatgcttcacctagtcatgaagcattaaaggttgtggcagccttgttctccatgctttttcagtacatttgatgttgtatggtgggggcaggagcatataagccagtgcaaatggtttttgttgcggtctccatacagaccaggggtctatttttttttttttyaaacttgaaagaaaagtaaaacattttacttatccttaaagctaaaaggggcttgttaratntcaaaragggyyctgagttaaaaaaatgttttatttgccccaacaaaaaagtaggaacatgttaacttgaggggggcttattaaggaaagttttkggggagctttgraagcttactaggattttaggaaatgccygatctcaaaaaccttccttaaaaatgaaaagtctgcaattcccaaaaggcagtccttccaaaaaccatyaaaaggatttattctgnatgctcgaaantctgcnttaccncntaaaatgaatctccggattttaangaccgcnctttaaaaaggctttaaaattactgtttaanctttgaaagcccgcttangctgcctcngttn

SEQ ID NO: 23333 - DNA, 996 bp, Homo sapiens
  misc_feature 2, 8, 12, 18, 19, 20, 28, 39, 44, 52, 67, 75, 815, 972, 982,995: n = A,T,C or G
antactgnggtncgatannncttgcttnttgcttttggnccganccggcctncggctcgacgacagnagggaagnaatgaagaattataaaaaagttaagaattttattttgaagactgatattctaagttgcatatagcaaagaagttacgaacttttakagtmaasgacstcatwacacatgatagatgctaattktaattaartttmttatgdcasrakktgaaaaatggggtaggaggagagtatgaatcagaggatgaagtaactcacaatttaggctataggggccacatttttctaacttaatattccatgattatttccaaaggttacttaaatccaatatatgactcagagcttcagacttaacgtcatacattttcacataggttttaatttgtggagaaaggacatattctgatattattatagaaaagccattggattctatggtgtgataataagagatttcaggtctgggtcttctttatcagtcagcttttgtattgcaataacctacaatctcaattctcaaaggcttagagcaagatcatttgctttttgttcatctgaggactgccgggtgagtttgggttggctgggctcagtttcactgggcttttgattccaggagcccagagtgaagcagcagccactatcctgcagttttcaacgcagaggacataccaggggagacagaggctgagccaaatcaaataatcacattgaaaccttttgcttaatcataccaatgtcatggctgctcatatkcattagccaaagcagccacatgacttggcagaagttcatanggttctgatgcttattcctccmtagaatgaacaggawtctcatataacttgaattgactatwtcaaatccmttgctggaagtggggaatagctgggawagtaatccctggtttmctwtsccmcaatgatcrgcacgtttcagttycwctggcaaaanagscygcttntggaagcctctcnt

SEQ ID NO: 23334 - DNA, 1137 bp, Homo sapiens
  misc_feature 2, 13, 23, 36, 1014, 1026, 1045, 1126: n = A,T,C or G
tncggctgcgagnagacgacagnaggggatctcagntggggacaaaacagtaaaagagaaggaaatgtcaaatagtaaagccacagacacatttaaaattaactttttaactgtaataataaagtaataattaaatctgaggctattaagactgttatccaaggtagcgtatggttattgattgtttatactaaagatagaattttgaccaccagttatggatattctctcacataccttctttatcatgtgttctctatttttgttgactgaactgaacattttgttatctttaaaattgactgcctgtgttattgtaagaataacaagcataaacgtacacatttgacagagaaaatatgccaatcatrrkgggctaaatgacttttcytaattttaggaattatatagtcagtggcagaaaagtggccaattttttctggaatyaatagcacacaatataacctgggatcccacaggtaagaaaataagcaggattaactaaaatgaaatatcacttgcctagttgttcttatttttattactcttatgtatttcacttctgctgggtgtgaggktgtggggaataccaaagaagtaaaatggattatgcccttttagagtttatactgaaatgaagacagatatgcactgtaagaaatgagagratgttctaagtgccataataggatacccattgtttttggaaagagatatttctctggagaattaacgtttcattgaaaaggagcctttgrmcctgagagtamacwkacatkwagywrkgagagkwgggtagatggaacaggaaaaaagtgaaatttaagaaaatatatgccaggcgtggtggctcacgcctgtattcccagcactttgggaggctgaggtgggcagatcacctgaggtttgggagttcaagacccgcctgaccaacatggagaaaccctgtctctactaaaaatcaaaaaattagctgggcatagtggcgcatgcctgtatcccagctcttgggangctgagctaganatcgtttgaccttgaaggngaggttgcagtgagctgagctctgccttgccttcacctggcacagagtgaactgtctcaaaaaaaaaaaaaaacctgggcncttttcctaac

SEQ ID NO: 23335 - DNA, 759 bp, Homo sapiens
  misc_feature 1, 9, 749, 755, 758: n = A,T,C or G
nacgacagnrggggtaaccacctgggaaaacttcacagaaaatgagagtttcagatactgagaatagaaccactaagaagcagaaaagagaagatattctcgtgggggagaacaacggctgggaggggaggaagcatggccaaggcaaagaggtgggcattaataagaactgcttcttgctgccgccatatgaagaaggacgtgttcgcttccccttcctccatgattgtaagtttcctgagacctcgccagccatgctgaactgtgagtcaattaaacctctttcctttataaattacccagtctcgagtatgtctttattagcagtgtgagaatggactaatacacctgccatgcctgttccttacttactaaaaaaatttactcccctttctccatagaatgcacgcaatttgaccttatgctacacttccagtctctactcctgcctctttatgctctgtccacatgtgatttctcactattctctacatggcttgtgcccctataaggtttgtgcccttcatttcctgtgccctctacctctggttcccatgctcagaatatcmagtgtccttactgcaggggtgtataagctcagatctcacctcctycatgaagcccctatagacccccagagaggattaataatgraccctcctccatgtttccctaaccctgctagrcttkctcckgrttttttgtttttaggctatgaattaggctttaatctctttaactctaagganaaaaanagng

SEQ ID NO: 23336 - DNA, 825 bp, Homo sapiens
  misc_feature 599, 617, 646, 684, 778, 815, 820: n = A,T,C or G
ggggagtcattccacaaacttgtcttgagcacctgttatgtagacagcagggggaggagacagggagtgaagtaaaaagacatggttccggcaggaaacaggcaaggagagccttgacttgacggagtctggctatatcgccaggctggaatgcaatggcgcgatctctcctcactgcaacctccgcctcccgggttcaagcgattctcctgcctcagcacctcgagtrgctgggactacaggcgcgcgccaccacgcccagatgagaaaactgaggcacagagaggtgaaataaggaatgaaatattactggatgaaataattatactgatcctagccttattttaaaagggcccccagaatgctcttctccaagacttagaaaaatcaaatgctatccatccctcaagatacatccctccagcccctccttgaagtctcctgcagctagaagtagaagtagcatctatccccatctggactccttagcactttgctgtacctgccttagtccccatctctttacacacacacacacacacacacacacacacacacacacacacacagagtattataacactatcacctattatatnacattatattattggagntctacaagaactacaaagaattctactgngaattycttaggggggggatacattatacaatcatcantgtttctctattaggtggggaacaaaaaagtgagcgcccgatgaaaaattattcacacactacgtgcttttttccaattgaaatgtaaaatttntctgktaaacwattttaagggacgtgtatacattyanatttnctaca

SEQ ID NO: 23337 - DNA, 840 bp, Homo sapiens
  misc_feature 1, 19, 782, 814, 829, 832, 833, 834: n = A,T,C or G
ncggcctacggtctgcganaatagacagtaggggcaaatgtgtaaaatatcaatactttatgttcaagctggggcctcttcaggcgtcctgggctgagagagaaagatgctagctccgcaagccggagagggaacaccgccacattgttacacggacacaccgccacgtggacacatgaccagactcacatgtacagacacasggrgacattaccacatgggrgacaccgtcacacagtcacacgracacactggcatagtcacatggacggacacacagacatatggagaaatcacaykgacacaccaccacactatcacagggacacagacacacggagacrtcaccacatggacacactgtcacactaccacagggasasgrgasrwcaycacactgtcacatggacacaccatcacacacatgaacacacygacacactgccatatggacactgscacacacactgccacactgtcacatggacacacctccacaccatcacaccaccacacacactgccatgtggacacaaggacacacagacactgtcacacagatacacaaaacactgtcacacggagacatcaccatgcagatacaccaccacatggacwtagcaccagacactctgccacacagatwcmccaccmcacagaaatgcggacmcmytgccacacagacaccaccacatcgtkgccacrytttcatgtrtcagswksmggtgwgggccccwygactctgggctmwaaycragaaawkrmktggacakatagtgaangcaaaattttttttttattttctgagacgtantgtcgctctgttgcnggnnnggggaa

SEQ ID NO: 23338 - DNA, 1031 bp, Homo sapiens
  misc_feature 2, 11, 12, 16, 21, 22, 27, 33, 44, 46, 64, 67, 75, 736, 966,967, 974, 992, 994, 995, 1023, 1024: n = A,T,C or G
anatcttgggnntacnaaccnnctttnttgttncttttggccgnancggcctacggttgcgagnagnacgacagnaggggacttttgggttattccatcagcaacacaagtaaatctctctagtatactatttatctcaggagtgacaaatatgtgttaagaatgacttctattacccctgcattataagtttattttttccagtatttttttccctttgatttgagacttagcctaggcatcattcccaaagaagtgctccagacagccgccatgaatgaatcagaactggcccttggaaggaggcctacctgccgggtcctctaatggacataacttacttttmcctcacagtgttactcagtgctttatctactagggctcatgagatgcagtgttcatactgttttgtttccagaatccctgggtgtgttttattccctcagttgtatataacaggacgcacaatggggtcaggccaatattttttggctcttaaaaggactcttgctgaggtttgccagtacctgctgatctgcagctcccccagcttcataagcagtgataggagtactgagtcagccccaaattaaagaaccatgcatagaacaatgccctgcagcagactcgtaggacaaatctgaaagagcatccccagactcttgaggcatagatacctcctgaaaataagggtctgccttctataggtcattactttggaacatttaataaagcntaccaaaaagaaaaaatacatgtattttataccctcacatttctttttagtcatctttagttttgcttacagtctgattaccccctcactcccaaatccttagctccttacaaaaaggaaaaaaaatattttctataacatatatctggaagttttaattttagatttatagtttcacattttcaagccagtatttttctagttccattttgctctatttctagatcccnncggcccnaagaaaaaagcggcgttncnntcattatttccccgaaacaaaaaaaaanngaaaccc

SEQ ID NO: 23339 - DNA, 724 bp, Homo sapiens
  misc_feature 678, 680, 681, 686, 712, 721: n = A,T,C or G
gggggtacagtaakkgttaacgtctatttcctattgaatcataggttaatgaattatgattaggtcgtcattgtcttacatatactttctagaaaacatttcaatttattatgacaaattacgtcagtaaattcatttaacctttttgtctttttaaaaaacttttatgacctctatttacttaacttcatatataatcaataaaacaaaagaagtgaaaagagaagattgcagccaagaggaattcgttacaaacatgtatgagattttttaagttttttttgtttttaattattcctatttcacgttcacatggaaaagtcagaaagcataactactctaggccgggcgccgtggcacacgcctgtaatcccagcactctgggaggccaaggcaagtggatggcttgagtccaggagttttgataccagcctggggaatatagtgaaaccccgtctgtcctaaaaatacaaaaaattagctgggcatggttgcgtgtgcctctaatcccagctacctgggaggctgaggtggggagaatcacctgagcccagaaagtcaaggcttgcagtgagctaaattgcgcgactgcactytwrcctgagcmaccaaagtgrgaccctgtctcaaaaggaaagcatwactgcaaaaaaaaaaaaaaaaaaaaacccctggggncnnttttngggaaacccacttaaaaaaccttggnggttggganccc

SEQ ID NO: 23340 - DNA, 1343 bp, Homo sapiens
  misc_feature 27, 33, 38, 40, 46, 62, 582, 1326, 1328, 1333: n = A,T,C or G
gaaagacaggttcaccatgtggccagnatgatntgatntnttgacntcatgatccgcccgtnttggcctcccaaagtgtgggatcacaggcgtgagccaccacacctggccctctatttattctcttaaagagagagaaaactatgagaggccaaaattatttaattaaatctttaccttagcgcaagggaaaaaatggaatttgcctaatataggtgatgaagcatacacaatgaacagaaacaatcacattttagtaaaaggcaaaaatttgagacttataagctatatggtagcttatttttgggtggggaagaaatgagaaaagaatataacatctcttactggcatggcacattttgataaaaaatcttattgtcctttcctactagaatgatccactgtaaggcaaaaataatatacaagcaaagtttttttttggagacggagtctcactctgtcacccaggctggagtgcagtggtacgatctcggctcactgcaacctctccctcccgggttcaagtgattctcgtgcctcagcctcttgagtagctgggattacaggcgcgtgccactgcgnccggctaattkkkgtatttttagtagagayggggtttcaccatgttggccaggcatgrtctyrawctcctgacctcswgatccgcccacctcagcctcccaaagtgctgggattacaggcctctgcgcctggccttgcattgacaattaatttgtttatggaaagccagttatccaatgatggtgaacaaatgcaacttgactgtataatacttattttggttttggaccaaagtcaccattaaatatgccaagttcttgttcaaggaaacagctaatgtcgtggacttgcatctcatttgtagttggttctccctgaaaagtcagtggtgtgggagaaatgatacttagtcaaaatcatcagtgaaaatcattgcttggatcatcccaaaatataatgaacaaaagtgatatttatctgccacattgagaaacattcaccatatctcaataagctctcctcagccagttggtccttttgtggttgaaaaaagtgccatatctttggttgggcatccaataaaatatggtatttaggggctacctgtatggaaaatccatatccttaaaggttagctcaccaggaggatgttgagaaatggcacaaggggctgggcgcggtggctcatgcctgtaatcccagcattttggggaggctgaggtgggtggatcacttgggtcacgagttcgagacagcctggccgcatggtgaaggccatgtctgctaaaatataaaatggcaggngnggggnggcgctggga

SEQ ID NO: 23341 - DNA, 873 bp, Homo sapiens
ggggatctgattagaacttccctcatttttaaaatgcttcttgacatggtttggatttgtgcaccccccaccsssaatctcatatggaattgtaattgtcagtgttggaggaggggcttgctggaaggtgactggatcactagaggtggtttctaatggtttagcctcatccacctcgtgctgtctgatgataaagttctcctgagatctgcttgtttaaaaagtgtgtagcacctcccctgactcttttcagccatgtgaatatgtgcttgcctccttttcaccttctgccatgattgtaagtttcctgaggcctccctataagcataagtctgtacagcccacagaactgtgagccaattcaatcccttttctttttcaattacccactctcatgtatatctttatarcagtgtgagaacagattaatacactcctcctcagaaagcattcaatttagytgtgtctaaagtatgccaggtgttctagggtgttatcttagccaataattcttcctcttcagcaagatctatttgcctatgacagcttgacctacatttcctaccatacttgtcagtaacaagtagcccataacatctgaatggacttcattgaaatcacagaggttctttagttctctactttattagcaggcattcgggaaacacatcaactttctaatttaataagggcctggtgctttgaaaactgctcaaagarataggagaggcttacttaaagatatactatagrcatggmtgctggtcacacctgtatcctacctttgggaggctgaggagagaagatacttgagtccagaaggcgatacagcctagggacatggcaagccctgctctacaaagaaacaaatcc

SEQ ID NO: 23342 - DNA, 976 bp, Homo sapiens
  misc_feature 2, 8, 14, 17, 19, 21, 22, 28, 34, 45, 47, 54, 65, 68, 76,196, 885, 935, 975: n = A,T,C or G
antaactngggttncgntnanncttgtnttgttncttttggccgnancggcctncggctgcgagnagnacgacagnagggggtctgactttagtgagtagcagtagaaatgtagagaaatagacaaatttgggagatacttaagaagtagaaatcttggtgatttactcagttagaatttaaaagtgaaacccagntttcctgtttggtcaatgagtagataaatatgcctgggataagaagcaggggaaggaagtgggagaaggatctgatgagtttgaggtacctgggagaccctaggaatgttgatatatagatatgaaactccataaaagtgtgatcacctcatcacctataaaaagttgatctgggctgactaatcaatatttggaagtcagaggcagtaaaatgacaaataaaggccttgggtgatgatgagctctctcagggaaaatgtttaaactgcaacaagagaagaaccttagggaagtatcaacatttaaggaatcagttggaaaatgggagcctacacagtagactatgaaggaccaaccaaaaagaacaagaactgggtggtatcatggaaacccagggaagagagggcttcaaaaaggaggatgtggtcagctgtagtgaatattactgagagattgtgatggctgaggcctgagaagagactactagttttaacaacagtgttggtggtaacattggtcataatagtttctctgaaggggtgaccagagagctgcmagaatgaggagaggtgagtgcaaaagtgaaraaaagacaaagacacacttgtaagtttyactgtaatggaataaaggaaccaggkctaccamggrcatggttgagaggcctttttctttttatttwaaaaganacmcttgagtgtgttgaatgctgtggaatracmaaatgaggaaagttgankycaaacaagggraaaaaaaaaaaaaaccccggcccttcnc

SEQ ID NO: 23343 - DNA, 812 bp, Homo sapiens
  misc_feature 734, 811: n = A,T,C or G
gggggtattattagkgkmcwgttgctatgacaggaaccgcatgagacacacacgaaagacggccctgccttccagggctcgctagatccttggttcctgtcgtggaagagaggggcagagtcttgctctgtcacccaggatggagtgcagcggcgtgatctcagctcattgcaacctccacctcctgggtgcaagcgattctcctgcctcagcttcccaagtagctgggattacaggcgtgcaccactacatccagagactgggactacaggcatggattttcaggtttataacatggcagagtgaattctggcaacacactgagtgatgcttgtcaatggccactatcaggaatttaaaacaagagggagggcctagctctgtcgctcgggctggaatgcagtggtgtgatcatatagctcactacagcctcgaattcctggactcaagcaatcctcttgcctcagcctcccatgtacctgggactacagatttggaattatgacatctggacaaacacatatgcaaaacctaccttttggtccattctccagggcttcttctgcagcttctggttccagttckttttcggagctgtcagtgtgtgttttggcctgtcattaactgacatcatattacttggacagttgcattcacttttgatgatgtaggcaaggaaaaccagccctactacttcctggtggttctggatgctgcctacaaccaraaaaagngaaacccctgacaggaagctrcaataaaatctgccctgggtacatctgawcatgctttgcctacaaggcttgctcana

SEQ ID NO: 23344 - DNA, 975 bp, Homo sapiens
  misc_feature 11, 14, 21: n = A,T,C or G
taggctgcganagnagacagnagggattctgtggattgtctcttaactttgttgattgtatcattttctgtgcagaagctttttaacttaatgtgatccatttgtccatttttgctttggttgcctgtgcttgtggggtattgctcaagatatttttgcccagaccaatgtcctggaggtgttccccaaagtttttctryastagtkktatagttcgaggwgttggctttacatctttaaacaactttgattttacttttgtatttggtgatagatactagtctgttttcattcttctgcatatggatatccagttttttcaataccatttcccaccagtgtatgttcttggcacctttgtcaaaaatgagttcactgtaggtacatttgtacatttgttactgggttctctattctgttccattgatctatgagtctatttttatgccagtaccatactcttttggttgctataattctgtggtataatatgaagtcagaaaatataattcctccagttttatttatttatttatttttgcttaggatagtattatttcttatagtgaaagcattctatgttatttattattagtctaattttgtagttttacaatgctatcctcttttacaaagctatgatcaactcagtgtgtccagatcaggatcatttgtagctatttgcaaaagtagcaatattctggctgggcatggkggctcatgcttatattcccagcactttgggaggccaagacaggcagatcacctgaggtcagaggktcaagaccagcctggtcaacatggtgaaaccctgtctccataaaaatacaaaaattagccggggatgatggcagatgcctgtaatcccagctactcaggaggctgaggcaggaaactcacttgaacccsgaaggggaggtgcagtgagcccaaawgtgtcattgcattccagcctggtaccaagccgactctgcc

SEQ ID NO: 23345 - DNA, 805 bp, Homo sapiens
  misc_feature 1, 8, 18, 687, 732, 802: n = A,T,C or G
ncggcctncggctgcganagacgacagtaggggatccaaattcaaaaaggcatctgaaaaatttaacagctgaaaaacactttctccttgctgggaaaacttaaaccttgctaggctttatgcaacttaaaaaaaaaaaaatcacttctgtgctgagaactagcatgagaaatctcagcatgaaaggttggtggattttttttcttcataaaactaagcccaattgttggttttaagagtgatgccacaatatacatatgctttgttaggaacaaatataatctaatttcaagggcatcttcaacaaaaattagggggaaaagataaaggctacttaagcagtgatccagtgtctgaaagcaaaggttgagaacatcattgtaccatcaaggtctaraaatgctgctaaccctgagcgggttgttactgtttgaaaagcctatgggtatttgttttattgttgtctcactcaattcttacttagctgagagtatctcacaagggaagtactgctctgtgatggtgtcctggactttgttttctatttgtttcagcacttcaataaatggtctgttacctgccattatgacctgtatgcatttgctgagcagtttttcaaaacaaaacaaattatgtggctgtatttctagaacgctgagccttttcaagatagtttagattagaacnccctagacccgtcccccattggatgttatactgaaccmtttttcnactwttcaggaaataaaaaaaaaaaacggtggcatycawttgsaammmaaaraaaaaaccytggccstknccc

SEQ ID NO: 23346 - DNA, 823 bp, Homo sapiens
  misc_feature 10, 13, 17, 18, 29, 772, 810: n = A,T,C or G
ttttgacctncgntaanncttgcttgttncttttggssgtacgkcctacggckgcwstmggagrcagkgagcatgcgctccggctccaccacgaacatgtagtagaggttccacatcagcatcgacagcagtggcagaaacgtcaggccgtagccgaagcctcggaaggagcggcccacggcaaagagacatggtcttgctatgttgccagtctgggctcaaacttctggccttgagtgattctctcacctcagactcctgagtagctgggattacagatgcgggccaccacacctggctgtacaaactttaaaatgtttgagcaaattcaatgagtatagtaaaatatcttcctccctttaccgattcccaccctattctcccccacccccaccccaggcatcaatattatggtttcttgtgcactgagtgattttttaaattattattatttttttatttttgagacagagtctctctctgtcacccaggctggagtgcagtggtgcgatctcagctcactgcaacctccgcctcccgggttcaagcaattctcctgcctcagcctcctgagtagctgagactacgggcgcccgccaccatgcctggctatttttttgtatttttagtagagatggggtttcacccgagatggtctcaatctcctgacctgatgatccgcctgccttggctcccaagtgctgggatacargcgtgagccmccgcgcctggcctatttttttttttttaaatataaaagggggttgtgtcnccaggtggaggcrggggrsccccmattctgagctaggngtctcccccaagc

SEQ ID NO: 23347 - DNA, 1021 bp, Homo sapiens
  misc_feature 2, 19, 828, 858, 872, 878, 886, 906, 928, 929, 935, 946,957, 964, 978, 979, 981, 985, 994, 995, 996, 1017: n = A,T,C or G
antaacttgggtatccarnatamttwtttrtkamtwtwgrcmkgaarrktwgtttttagattgtctacacagtagcttcccctttttttgaacatagagtagaatttgtaatgcttttcttttttctccatcagtactataaggaaaatattattaaacacccctcccctgcccaacctttttttaaaatagagatgaggttttgccatgttgcccaggctggtcttgaactcctgggctcaagcagtccgcctgctgcaacctcgcaaagtgcttgtattacaggtgtgagctaccatgtccggcccaccctttcaaacaaatttggttgtagtttgctataataatatactaaatctatgtttatttgaaaggagcctttaccttttaaagcaaaatgcactttccttaaatataaaagtaatatggtttactttaacatttaaagttcaccttatctggggaggcagaaggaattttcatagtgcttactgtgttaattattatgagagatgaaccatatgtgataggtaaagtacatgtgtaagaaagacaaaaaaattttcctctttttataatccatgaaattcgaaaacagaaaattattcaaagaataggcaaatgtcatgacagaacttagtgtgagcaagtcattgagaattaaaatctaacttttcaggtcagagagccttgaaatacttacaataaagttataaaggcctaggtatttttctttcttttttttttttgaaaggagcttgctytgcccccaggctgaagggcaggggcccaaaggcctaaatttttttctawatttggttttagtcntwagggggrgaatttcaccaaagtcttganggccagggcccttncccctnctcctttnaaaaaatttttaacctggcncagggactggctcggaactggnntgccanccctttgggancccaagggggnggatccnttgtcccccaagtnnanaacnccctaggcnnnttagggggaccccctcttttnaaaa

SEQ ID NO: 23348 - DNA, 999 bp, Homo sapiens
  misc_feature 9, 856, 892, 955: n = A,T,C or G
gtagacagnagggcaactcagccctgctgctctcattatgtcttccccaaaccaggaggcagttgcaggtcagtgattacccatggaaagagcatctggccaccaccaaaccttggcgttctactctaccctagaccagtaggtaagcccaagtccacacatgtctatagggcatatcctctggccttgtccaccttgtgtggctgagtaacaaccacaaaaatctcacccagcatgggagcctgtcatacagctgtgcccaactacaggttccaaacaacagagccagggaagacaacttgcaactctacctaatcagacatggctgcagagtccaatcagcagcctcacctgatggcaaagttcagctagtggtttcactgatcacagagcacagccagaaatactatttgatctcagagcacaggaagcagctcagcccaattatagaacctgacaccaagcaaaggctgccagccacccctccagaatctcaggctagactaaatggtaaagatctataaccaccaaaaaacacctgcaaaggctggaaaatttggctttctcctcaaatgcacaggcataaggacacaaagataatgaaaaatcaggcaacatgacaccaccaaaagaaaccaataaagcttgtgtaatagacccagaataaatggagatctatgaaatgactgacaaagaattaraataatcctctaaaagaagttcagggaactacmagaaatcgatasagattagwgarttaagtraagtttasaaaamagtttakaasaaaragaaagtttgacagagaaatgtaagaaacaataaaaaatcaatgaaagtcttagtgataaaggtntattactgaccctaaagtcattagaagcttcaaganactggtatggtggcacgtgcctgaatccagactttgggggctgagcaggctatctttgagtcnggagttcagacagactaagcatatgagaaacctgcctttacaac

SEQ ID NO: 23349 - DNA, 904 bp, Homo sapiens
  misc_feature 33, 804, 825: n = A,T,C or G
gtagacagtaggggaggwmrckgcwascswggnagtgacggwgccryygyggygmrysgargattgcgccattgccctccagcctgggcaataacagtgaaaatctgtctcaaaaagaaaagaaaagaaaagaaaaaaagatatatactcccctaagaaaagaaaaaaagctatatactcccctcacaaactggggacctcaagatctccaccctaaaatagttattttgaatttccccctggcaatgtaaaccgagagcttatctgcacaggtgtgggacagaaccaatccctctgcacacctgagacaaatgcctatctgattgcttcccctgccctattgtttacataaaaacgcagggtcactgaggcagtcgaaggcattaagtgactattcctcctcccgctctcacatataaattgtgtatttagtgaaaggttgatcaaagactcaaagaatgtgatcatttgttatctacctgtgacccggaagccccccaattccagttattccacctttccagactgaaccaatgcatatcttacatgtattgattgatgtattatgtctctgcaaaatgtgtaaaaccaaactgcagcctgaacaccttgggcacacattgtcaggacctcctgaggctgtgtcacgggggcatttttaaccttggcaaaatagatttctaattgactgagacctagtagatacttttagttcacaagctcatgaacgcagaagaaattgagagaataagaaaaaagctaggtgtcatggagagcacgaaatcagttccaaaatctgaactncttcatatttattcaacatanggaaatgctcttcactttgtgtgattagattcatttgcgaatgatatatatttctagtatttgattaaataacccattt

SEQ ID NO: 23350 - DNA, 973 bp, Homo sapiens
  misc_feature 3, 854, 863, 873, 892, 910, 911, 914, 937: n = A,T,C or G
ttntktygacctasgakrsawcmtkgctgatgtwasywwwgkmckyaayggmsttskgtttytgcgagagamgacaraatgggttatcaacaagtgtcatttgaggtccttttcccaaaaacaccagagtatgaggttataggctgcctggagggcggagatattttatcacagagttaagggtggagaaatggggagaagaaattgataggttttccaaaccttgctttgccttctggtgtcagatgataattgtttttgcaaaatgctgcagggtgagagagagtgagactgacttactcttttcagcattaaactggagggaaagaattacagtgggagctgaagagtgacctggtatgtgtgggtgatgaatagaagaacactttaccccaattcttctgaagcacagtaaagaggaggagaaatgaaccagtttgcaaaagtgggtctacgttagctgaaaatatgcagcccttgagtttatatggagttctagacagatggacacatgtaggtactgccgctgagtgggcaggtgtattacaccttgctgggagtgaatgatggcttatttgtcagcgatttacaaatcctaagatggagaggtagcacgggagtacaaaggccaatgcagcctcaggttcacgtgcttttgagatgattaagaaatgcaaagttaggctggscaggtggctcatgcctatgatcgtagcacttggggagatcaatcctacactttggaggcttaggctaaagattgctagctarggggaggatcgcttgactcagagtcaaaccagcctgggcaacatgrtgaaacctcgtctctattaaaaaaaaaaaaaaggccngggctttanctccccctgnatcccggcctttggagggngggggtggtccttggggnngantcaaacccccggccactgaaaantttttttcccaaaaaaaaaaaaaaccccgggccttt

SEQ ID NO: 23351 - DNA, 824 bp, Homo sapiens
  misc_feature 729, 792, 796, 799, 805: n = A,T,C or G
gggggaatctcagaatcaagttctggggtcagggcccacaattggtggtttaacaaatcatccagatgaaattgatgcacactaaagattcagaaccactgttttaactactaccctgtcatagtccattttctagtgcttatcacagaakrkctgaaagtgggtaatttataaagaagagaaatttatttcttctagttatgactgaggagtcccaggtcatggggctgcatctgttgagagcctccttacttgtggggactctctgagaagtgccaaagttagagcaggagtgccaaaagttagagcaggaaccagatttcctggtcttagcatacaagaaaatggaggcgatgggaatagagtgtgcgtttctaaagtttaagaagtcaggaaggaaagaaatagagcatactaggtacagagggtgactgtgccaagcaaggttttcaagttggggtgggcaggagcagtaaaactcatggaaatggaggatgtgctgagaatacttgaggaaacaaggcctgaggagatggaaagagaatttaaaacmtttatctattatgtgattattataatatgaacctctgtttcctatgtgatgttccytgagtgtagaatttggttctttcttactgtgatatacccagcacttgagatggtactgacagattgtatatgcttagtaaaatttgttgaatgactgaaagaattgcattgggagtttantttatctcacacctgatggatatatgaaaaattatgaattggtaaagggagtgtttaaagtanaaanaanaactgngggagctcacatccactgc

SEQ ID NO: 23352 - DNA, 996 bp, Homo sapiens
  misc_feature 864, 882, 888, 901, 924, 964, 991, 994: n = A,T,C or G
ggggatagcactaggatactcatttkkagcatgarccctattgtgaactgctcatctgagggatctaggttgtgtgcttcatatgagaaactaatgccgtgatgatctgtcactgtctcactttgsccccagatgagaccatctagttgcagaaaaataagctcagagtttccacggattctacattatgatgtgtattctcattttatggaagacatgttgccagagtaaagcacaatatattcatcttgaaatgtaatactgagaagatatggaagttatggaagttgtggccttcagaattgacacttacggagagactagaacagcgtgggtgagttgtgaggggcaggaagcatgtcttaatggacttaaccaattttcgtcaactattcacagtaaaatctttcaatgtacaaaatttagtaatctgataaacaataaacaaaatatttgaataggcatttttcataagacgtacaaagggcagacaggcatacgaaaaggtgctcaacatttttgatcatcagacaaatgcaaatcaaaactacaatgagatattatgtgactcagttaaatggcttatatccaaaaggtaggcagtaacaaatgctggagagaagtggagaaagggagcccttgtatgctgttgacaggaatgtaacattttgaaaattcttcaaaacaactaaaaataaagctaccatataattcaggaatgccactcctgaggattcacttactagaaaggaaatccatcattgaagagatatctaccctgccatgtttgtacagcagtgtgctccagccaatatttggaagtacctgatgtcmtcaagaaatgactggataagaaacatggcnctataccmatggatactnttagcntaaaatagatctntattkcacacattgtggacctanattaakgaataascagccagaaacactttctgtctccttntttgcggactaaatcaacattactctntgngg

SEQ ID NO: 23353 - DNA, 976 bp, Homo sapiens
  misc_feature 2, 9, 10, 11, 30, 35, 51, 94, 106, 109, 919, 944, 955, 964,965, 966, 967, 968, 969, 970, 971, 972, 973, 974: n = A,T,C or G
anatacctnnngttcgttacaacccttcgnttttntgcttttgggccggangcggcgcttacggtctgcgtaggagaacgacagtaagggggangcattgtaaagnttntgtcaaataataaaacsagtcctcwkcagrgcamagtggtcgactagtaatttaataacctgctagaagaaaaatgcattgcattagagaaagataaccaaacccagagtttgtataaatatcatgcacaatgttcaactgtaattcaaaaattaccagtgatggatacagaaaaatgtgacatgtaatttttttttaaagtccatggaaatagattcctcgatgattcagaagttgtagacaaggactttaaagcagaaattataaatatattcaggattttaaaaaaatatgttttcaggcccggtgcggtagytcacgcctataatccaccagatgtggtggcgtatgcttataatcccagctactcagaaggctgaggcatgagaatagatagcttgaacccaggaggtggaggttgcagtgagccgagattgctccactgcactctagcctgggcaacagagtgagaccctgtctctaaaaatatatgtatatatatagtcataatgagggaacagatgagaaaataagcagagaaatgaaaattttcaaaaataagtaaaaagttaaggtataatacctgaaatttttttgaagagtcattgaagtggcttaacaatagattgtagatggcaaaagaaagtgtcagtaamcttgaatacaggtcaatagaaattwttaatgttaagaacagagagaaaaggattcaaaatgtgcagagtgatctgtcaacaatatcaaccagtcctatacttgctgtttmagagagaaaaagagatgagattccaaaaaaaaaaaaaaaaaaancctgggccgttttccgaatccactnaaaccttgatnccccccccnnnnnnnnnnnaa

SEQ ID NO: 23354 - DNA, 1026 bp, Homo sapiens
  misc_feature 5, 12, 23, 26, 33, 38, 54, 939, 957, 999, 1021: n = A,T,C or G
cgcancggccgncggctgcgagnagncgacagnagggnaatcaactcaagtagnttaaaaacttaagcaswaggacytgaaackataaccmwwtacttgwwgaaamyytkggsmrmaaykkcctcggccttkygwstaggcwamgamwktakgackaacacctcaaaagccacaagcaacacaaataaaaatagacaaatgggacttaattaacttagaaagcttctgrgcagcagaagaaataatcagcagagtgaagagacaacctcctgaatggaagaaaatatttgcaaactgttcatctaatagtggactaatacctagaatttaccaaaaacccaaacaactcaacaggaaaaaaaaattccactggaaagtggccaaaggatataaatagacatttctcaaaagaagacatacaaaaggccaaaagatatatgaaaaaatgctcaacatcactaatcattatataaatgcaaatcaaaaccacaatgaaatattattttcccctagtcataatgactattcctaaaaacaaaaacaaaaacaaagcaaaacaaaatataacagattgaaaaaggaacccttctacactgttggtgggaatgtaaaccagtatagcaactgtagacaacattatggcgattcctcacaaaagtaaaaatagaatcaccattggaaacagcaattttactactgggtatttgctcaaaggggaaaaaaatcaatataccaaggggatacctgcactcgcatgtttattgcagtacttttcacaatgcaaagatatgaraccaacctaagtggggttttgggcttatgaaggtgatagtaaaaagactcagggtttgtgaagttggtgagggattttgcaaagctcttcwaactgctgcagaactgttgaccstgaagatggsaagggggacggctcagmaccanggatgtgctkgtgcgcangggcmgtagcatgagtgcwggtgtcccagcatgtttggggtnctcagtcccagtgggctggaanaggga

SEQ ID NO: 23355 - DNA, 1260 bp, Homo sapiens
  misc_feature 59, 1165, 1254: n = A,T,C or G
gggtggacatttgcttacatggggaacaccacacaagtaccgtatgagccagtaagaanatctggctagaaactttaaacaaattgctaaaggctgaacatgggctcgcaggagagggtggcagacccggggaggtttgtactttgttgtaggcgtctcctctgccaggtgccccaagggaagacctgggagaawckmsagaagcctttcctgkggtcttgaccgaggaagttgaacagcagccactgcagaacctctagctgaacccatgtccttcatctttcctactgactagaacattaatcttcaggaaggatacagaactgcagcctgagggcactggtggatccctctagagraggggaagaagaatggcaaccactagcaatattcaactcagaatcatattccctgtcattcctaagaaacaaatgccctaatctacaggaggaagggcaaccaaratgtatcctgaggttcctggtggaaactcactgtacccagaggaggagaaaagaagaacacaaaaaactctacccatggggaaggggcaggaatgtgcgctacctaacattacggtatatctggagaaagctcaggaacacttgtgaaggacacaccaccaagactcttgttcagagtgcctacctgaggctgaggcttaatcggaacatcagataccatcttctctcctccactctccaaccaccacactaacaagctttgagaagaataacagtggaatacaacttggagaaccatgcaaagggagacccaaagccaaggagggacactcatagccaagcagatagcagtcttcacaaacaactagactcctgaccacattaacagaaacctccacactgaagaactaacagaggaggaaggcatyctcatctccaagcatgcaatgtgcttacctggaatccactgtcctagatgacatgtttggctttcaacaaaaaattacaagacttacaaaacagcaagaaataacagtctgaagggataaagcagtcatcagaagtagaattagatttgacacagatgttagaactctcagacaaagaatttaaatggctacaatcaatatgttaatggctcttatggagaaggtaaacagcatgcaagatttataggccatgtcgccaagagatgggaactncagagagagccaataaaaaatttttaaatggaaaacagaaataaagatgcttttatgagttctcaatagactggcatcttgacatcagnggcatg

SEQ ID NO: 23356 - DNA, 1051 bp, Homo sapiens
  misc_feature 4, 970, 1049: n = A,T,C or G
cagnagggatcttacatttttaataaaaatatatgtgtacatggtttatcttgaagtattaatattttaaagtatttgtttaaagtgamkwyagsaargccattkgttttctttgataartgksrtcggtartgtaaaagttcctttatttccaaaataaattttacttagaaattatatattcctaataggtgtgccaagccatttgaatgtagactatatcaaagaagccttgatgaaaatagaagatgtatattcagtcgaagatttaaatatctggtctctcacttcaggaaaatctactgccatagttcacatacagctaagtatgttgctggtagtaaatgtgggcctggggttggtggacttctgcctttgaaactaaacatccctgcttataattatgtaggaagacttttctgctgaaaagatttgttttaagacaaaagcctttgtctttaaaaaacaaaggcttttgttaacagccttaaacaaaaggctctttaaagggtaagttgcaggtcagtattgataccagaacaataattttctatctctttgagatattacaaactgattttaaccttcagattaaaggtattaagaatatttcctgactggcatggtggctcgcacctgtaatcctagcactttggaaggctgaggcgggtggatcacctgaggtcaggagtttgagaccagcctggccaacatggtgaaaccccgtctctactaaaaatacaaaaattagctaggcgtggtggkgcatgcctgtaatcccagctmcttgggaggctgaggcaggagaawtgcctgaactcatkaagcggaggttgcagtgagccsagattgcgccmctgcagtctagtctgggkgcaacagactckcmrgamwmmawmtcgggaaaaaaaagaatatttcccggcctggcgcgttgactccgcctgtatcccacactttggaggcaagngggtggatcacctgagtcaggagtcagacagcctggccacatgatgaaaccctctctctaaaaatccaaattagccagncg

SEQ ID NO: 23357 - DNA, 876 bp, Homo sapiens
  misc_feature 9, 15, 844, 851: n = A,T,C or G
gtagacagnaggggnactctcttsskaccaacttgcgagtctaaaaccaaaaaaggagtttcttgagcctcatgagaatcatggtccaaaagtgttttccagatgtttccatatgttgtacgtagtaataattacaagatgctacctacgtaccttatacattccccaaattttacatctggtatttcacttctactatttgtacttctttgtccacttgctctgtgactgacagatggggctcagcttgattccagagctggcacttgacccgaggtcttctctgcctggcacagtgatacatggtgtagcgtatccatgtatgttgtctctgtgtgtgtttctcatactttcctagtgggctgaagagctcactaacttcttgtttccacttggcatgagtatagatttgacacctgccagtctcatttttcttctgccagcctagagctcccagtttttgactttgagtctcttgataggaattgcattttttattccacattttttggtgtctctgggactagagtataggagttttttccagaaaaaaactgattaaatctccctactgacattcacctgagctgtatgactctgtctcggtaagacatcagattttgggggttaggatcttttgaatcctgactggaaaatattctagacttgagatctgtcagtgtctcatccaccttaatccttggtcttagtcagtctgccgtccatgtaatcataagcattcaatagatcagaaagtacttgaaagataaatgaagaacatgattgttttactctctgtatgcttgagatacattccttgcttcagtcccattaagaaaatacntattatnaagaaacaataatctctccttcctg

SEQ ID NO: 23358 - DNA, 1344 bp, Homo sapiens
  misc_feature 1093, 1100, 1158, 1173, 1192, 1205, 1254, 1263, 1271, 1275,1292, 1304, 1312, 1317, 1325, 1328, 1329, 1334, 1337, 1338,1339, 1341, 1342: n = A,T,C or G
gaatttggacgctggatgtttcatactactcagatgataaaggcgtggcaggtgccatatgtagagaagagaaggcgattgctagagagccttcgaggcccagcacttgatgttattcgtgtcctcaagataaacaatcctttaattactgtcgatgaatgtctgcaggctcttgasgagatttggggttacagataatcctaggtagttgcaggtcaaatatctaaccacttaccagaaggatgaggaaaagttgtcggcttatgtactaaggctggagcctttgttacagaagctggtacagagaggagcaattgagagagatgctgtgaatcaggcccgcctagaccaagtcattgctggggcagtccacaaaacaattcgcagagagcttaatctgccagaggatggcccagcccctggtttcttgcagttattggtactaataaaggattatgaggcagctgaggaggaggaggcccttctccaggcaatattggaaggtaatttcacctgagtctcagggaaccacgaagggatatggcaacgagtagagcatgaaggtagaacagtctatatactcttgtgacacatacaatccctaccttgtgctgccaagtaactcatttttgtgcaattctcagtataagccctttgtcgtttctatgcctatttaaagtctcctaaaggtgtaattgactaggaaggatgtagttctacactgccatttacctatttaaattcatccttgtgaatatctttgttgttgttgktgagacagagtctcgctctgtcacccaggctggagtgcagtggcgtgatcttggctcactgcatcctccgccttgcaggtttaagctattctcctgcctcagttgcccgagtagctgggactacaggcatgtgccccacgcccactaagttttgcttatcagtaagacggggttcaccatgttggcaggctagtttcaactcctgactcagtgatccacctgcttcggcctctgaagwgstgggattacaggcgtgagacactgcgcccagcctcatccctgtgaatttcttattgtacacaagttctttcactatctgngtgcagngctctgagggacagacaaggcttgggtgtatatgccaaccagatctattgaagatcancttggttcgtactangtgcaagtgtagcatgtcncatgtgaccatgntggatcattgacatttttaggtatgtactgcctacattatgatgaaganctgagcggngttagatntaantattttcctatgaatanaatatactgatntgggcaancaaanaaaggcanaannaagcngannngnnaa

SEQ ID NO: 23359 - DNA, 733 bp, Homo sapiens
  misc_feature 5: n = A,T,C or G
ggggnaatagttgaattggggctcaatacatgtttgctaaatgatgattgcatttaactgtgagcagctttttcagatrkkaatcaaaatgcctgcaaagactacacagttgcaagggacatcagcttatatcccaacattattggttcctgatccatagttgtgagaccttggttgattccctgatagtacagcaactccctgggaatggaagttcaacttgttggctttagaacaacataagcagtttcattgaacattcactgaatgtctcctctgtgctgagcccatgtcagggactgggtctttaatcatgtycttgtatgcagcatccctgcactctacctgcacatgacttctgaacagcatgctctgcccagacagcctcagtgagggccaggacttgaaccctgtggaagcatgtaaagacatatttccgtggtggcagaaggctgagagttcagcatactgtctgtcttcacttttgagttgttctttcatctgcctaagactcatggcagagcactcatttcacaaactttcactgagtgccgactatgtgccaggcactgtgccatgtgctgaaagtacaaagactttaatatgtagtccttgacctcaaagagctcaagagtaattgacagaaattcctagatcatgatctgtgatgatgagaatcattccttagaaggcttgcatataaacatatttatatacttattttgtargaaaa

SEQ ID NO: 23360 - DNA, 971 bp, Homo sapiens
  misc_feature 768, 875, 876, 878, 879, 885, 893, 915, 917, 922, 923, 928,933, 953, 956, 966, 967: n = A,T,C or G
gggaactaaagtcactctattatgctatagaacactaaaatgtaatcctaatatttaactgtaattttgtactccttatccatccagcatttckkkcctgaagataaatgctgtaagaattttttttgctgaatcttcttttctgagaagtttctctcagcaattctctcctatgcttgttgtttcctacaggcagtttatactccattgarctatgagtttatctttgtaattccaaaatttgattgtgttactgttctgctagaaaaatgacaactgtctaatccatgaccagatgagagctaaaacccttagtgtggtgtggaatcttgctattcaggtgtgatcctaaaaccagcagtattaccatcacctgcagtctcctttcagaggcagaatggcaggcccagccatgaccaactgaatcagaatttaaattttaagatcacccagatgatatattttcatttaaaagctgaagccctagttccaaagaccactccagtttagccttatcttgcccctatagcctggtccttccacctcctccttcccctccttctactttgtctccactggctctcccttctctaggctcacaatggacttttcctgcctctagctctttatgtacaaagtgacctctgtccaraatttcctttcctgacctaagaaacttctacatagttgttatgaccsagaccagatatcctctcatctggagtttcttttcaaactatggcatctgacaaattacaattatttggntctgtcctctgctttatagcacattttgcttctatcttcttagcgctgattggggtggtagaattacctgctaacatgtctccttccccactagactcggggatggnngnnttttgnttctttgnttggtttcctctctctgaactnanaaagnncaggncctanagcccctaaaaaaggttgtnggngggggggggnnccgt

SEQ ID NO: 23361 - DNA, 972 bp, Homo sapiens
  misc_feature 658, 789, 821, 823, 836, 889, 912, 917, 926, 943, 956, 970: n = A,T,C or G
agggataaaataagtattgagccgggcatggtggctcacccctgtaatctcagcactttgggaggctgaggcggggggatcacggggtcaggaaatcgagaccattgtggctaacacggtgaaaacccatctctgctaatttttgtgtatttagtagagctgggttttgcccttgttggccaggctggtcttgaatacctgacctcaagtgatctgcccccccgacttcccaaaatgctgggactactggcatgagccagtgctcctgtcctcattccattcttcaccgtggtactgaccatccatttattcagcaccaattgtgtgccagaccttgtgtcagcattatggaggacttcccttgggaggcttgttagctgtacttgcaatctgatttgggttcccaaatcagcatataacaccaggtatttctctaatagagtatgtgccacactttctgctaactgcctgtttatcagtgtccccacatcccaatatctggttccttcaagggcagggagcacagggtatggcgtcagagtggtactcagtgatgtttactggtgggtagaaggaagggttagtccctgtttttgaagactttatgttctagcaggcagaaatgaagcacaaatagttcaagaaataaacaatttangaataaagtcatttggtttgcttcgcagaaatgtcttattgctgatttgccagcatgagtggcaaatatataataaaacctggccgggcatggtggctcacgcctgtaatcccagcactttgggaggccangtgggcggatcacgtggcaggaaatcaagacntnctggccacatggngaaatccctctctactaaaatataaaattagccagcctggggggggcgcctgnggcccaactcttggaggctgagnagganaatgctganccaaagcggaggtgcanggcccggatgccnctgcctcacctggnga

SEQ ID NO: 23362 - DNA, 794 bp, Homo sapiens
  misc_feature 738, 768: n = A,T,C or G
ttgtgwatastgktccrayaaacmtacgwstgcatgtgtctttataatagaatgatttatattcttttgggtgtatacctagtagtaggattgctgggtcaaatggtatttctgtctttaggtctttgaggaattgccacactctcttccacaatggctgaagtaatttacactcccacgaagagtgtaaattaaaaagcattcctttttctccacaaccttctcagcatctgttattttttgactttgtaataatagccattctgactggtgttagatggtatctcattgtggtttttgatttgcatttctctaatgagcagtgatgttgagcttcttttcacatgactgttggtcacatgtatgccttcttttgaaaagtgtctttttctaacttttcatctgctccttaagacctgcttttggagaaaagtgtatcagtgccagagagtgtggtaaggggtgttttccttacatgatattgktacatgtctacatgatcttgttacatgtagtaaacaagatgttcatgcctaattgaattctaggatgggcatggtggctcacgtctgtatcccagtgctttgggagactgaggcacgtggatcacctgaggtcaggagttcgagaccacctggccacatggcgaaacccatctctactaaaatacaaaaatagctggcatgggggctgcacctgatyccactacttggaggctgagcgaaaaatgcttgaccngagscgaggttcakgatcaaacwkccctgnctcacctgagaaaaagaactgctcac

SEQ ID NO: 23363 - DNA, 862 bp, Homo sapiens
  misc_feature 2, 828, 833, 834, 836, 845, 848, 854: n = A,T,C or G
gnackacagtwggggawtymytgaataasmvccyttwtbtgkwtccttttggccgcaacggcctacggctgcgacastacgacagaagggggattcggtaggtctgggatggtgatggggatgggacctgagaatgtatattgctaacatgctcccaggtaatgctgatgcttcaagtcttggaaccacacttcgagaatcactgttataatgtacagcagaactgcatgatcaggtaagtgtgctgagctgttgatcctcctcattcctgagctgggtgtgtagagacaagagcaggagactaggggctgatgatcttttagtcacatccatttaccccagagtgctctatacaaatagcatttttatgtattccccggcatgaaaaagctggaaagcaccaagagaaggttggtgttaaacaacatgaagttttggaatctcagaaagtctgaatgagttaatttttttgagctttagcatacttatcattttataatgaggataattccttaaagcaattctgtccaatagaactttgagatgatagaaatgttctgtatctgagctgtccaatggtgtagccactagtcacatgtggcttttcagcatttaaaaaatggctagtaagggtggggcacagtggcttatgcctgtaataccagctgtttgggaggcccaggtgggagaactgcttgagtgtaagagtctgaggctgcagtaactttatwtatggcaccagttcactccacttgggygacagagtgagacattgctaaaaaaaaaaaaamaggggccaggkbcagggctctmcmctgtatsccmccnttggnngntggggcggnggnacctgncctaagat

SEQ ID NO: 23364 - DNA, 1491 bp, Homo sapiens
  misc_feature 1298, 1367, 1404, 1408, 1429, 1443, 1462, 1470: n = A,T,C or G
ggggatcttaatagctgcacagtgtctgactctgttaaaggtgctcagaatgaatcttagaatattaatgcccatattttatgccatagcctctagagaggtgaaagagaagtccaaagatgggcagggttgctgagccaacatttctaaggagccctttttgtccgattcacctgccatctgcagccagcctccatataaacaccttttgtgatcaaccctgatggattatttgttagtttatttgttgggggaggggaataaagagaggaaaatgtgggagtacatgcgaatttagggtgaagcaaaagatttttagctacacagatcaataccacctttttctagctttttgataagaatgccaaatagaactgagtcaaaaatatcattgatcaatggatkgkatctattgcttttcccttttctgtatggttttccactccaccagagatgaaaattaaattgacttgtcactattttctcctcatataggcattcatcttgctcagggctttatttcttcaaattattccaatggcttacttaacagatgtagtttctttcttagttaartcaaaaggtatttattgagcaagtactgctaatactaccactgctactgctggtactgttaatactactgtctctactactgcaatgactggtctcatagtgttttaggctgccttcaaggtgcatcaccttatttaaattgtacaacaaacccttaagttatgtacaattatatgaggaactaggtctcaaaagttttataatttcctccagctcgtagtggcagggctggactccaagctgagatgtgtctggttgtccggttctaaacctttctacaggtcaccttgtaaagaataaggatggagctcaaacacagatacataaaggaataaaattaaaacttgttcctgcttttaaaatgtagtggttgaaaagccagaagtataaataactccagttctgtataaatgatattctcaaatgctgcatcagaatcgcttgggagaatttattaaaaacatggattcctagactgcaaccaaaactcttggatgagactaargratttgtaaattaaaaaraaaaaaaaacccggkgmmmttytctackaawyycaatgtccagmmaaytkkgagwrcymcysyttttaatattgaaactactgactttaatattgaaagtaaatataagaaaagatgaagtagttccaaccgagaaggaatgggaattgagaatggctgtttgagggtatctttatggttttcagggttatccaggcnttagaaattacataatgatttctacaatgatcatcggtagctttagactagtacctactaatctgaagngtgatcctcaccctgctattgatagatcttgtatttnatgngccgttaattgcaactctctntaactacgagatgnctttcgggacctagctggnatctagtntcgggactttctatcatgata

SEQ ID NO: 23365 - DNA, 1023 bp, Homo sapiens
  misc_feature 1006, 1014: n = A,T,C or G
gggatagtgcagttttctagcttccctttcacaaacggtgttgaagaaagtaaattaagcaactcagctatcactgggaatgcagtagaagtaatcaagtccagtgctgggagatagttgccatgatattccaacatggacaccaggatcacagtcgatgactatgccctcccttgaagatggtggcttgcctctctttctgtaagcaaatgtcatgtcataacagtattaaacaattacgagtaatgtccccatctgcttctgcactgcctttgaaatactatttcagatctgccaaaatarayrgcaaactsrktaacaagaaagcagggtggggggtgcattcatccctgccttcctgagtagtctattcacccaaagacaaaaggatgaccagcttccatcagggatattcaaagacacagtcaccctgccatgcagccagaggctggcaaaggtccaatcccctttttaagaagcttgttggatgagctctttaaacatacaaccacaaaggaaaggcacagccagtgtgagggaggctgataagatgggcattttgtttgcttcaaggktagaatgcaacttgtctatcaaaatgtggktatctgacctccacaatgctgcagtccagttaaatactgcaaatattcatccaccatttactatggataaaacaataatgkgctgtggggaatccaattacacagacacacacacacccaagaaagtgcacacacacgtgggcacacacactgstcctgytgcctyagarcttccaggccggcaaggagtaagtgcaaacwtwagtaggtaagtctgctaccaggaagaatatgataagtagatccaacagggtacaacgcagtatgatagaagcaaacaaggttgagatgagttctgactccctttccttataaaactgattatggaatagtttatgaaagactcgcctggatgaatctcatattttccagggttttctatcccaggattggaactttantcatcttnacattggcc

SEQ ID NO: 23366 - DNA, 772 bp, Homo sapiens
  misc_feature 10, 657, 678, 693, 748, 753, 757, 767: n = A,T,C or G
agacgacagnaaggggacatatactaactcgtttgcttcccacggtggagatggttatgattgttctccttgargaaagtgaagcccagagaaggcaagtaagtgccctgctcaaatttaattcacttgtgttgtctaacctcagtcactgtcctatcaccctgttttattttcttcggagccttgcttggaaaaacagtggtctactggtttgcttgcttgcccattgtctgtctcacagacagcacgagacatcgcctcatagatggcaagctccttgagtgcagggccttcatctttcttgttcacattcccaaagcttaactgatgctttagagaagctcagtgaatatttgtggaaagaatgagccactggcccactgaatggagactcctcgagggtgcactctgtgattattcatttctgttacccccacacttcctagcacagggcctggcacagatacagtgctcagtaaactgtttgttgagtgaataaatgaatgaatgaatgaatggaaaaaaattccagaggactcagttgctgktgctcttccttccagactctgggaactagtggaaagtcttcagccacaggagatgtgggagaatattctttctggatctctgttttgggttctctgggtgatttggggngtgcscagagtgggtacacanggcggaaagcatganaaaamatggaatgaaaaatcctggaatgactcctgatatttttctgtcaaggcanaaganaaanaaatttaggnggccg

SEQ ID NO: 23367 - DNA, 853 bp, Homo sapiens
  misc_feature 11, 21, 750, 762, 800, 807, 812, 822, 831, 838, 839, 845,850, 851, 852, 853: n = A,T,C or G
taggctgcganagaagayagnaagggaggcgcgttaagctggttgggacccgggaaggcctccctcttaaggtctttcccacacctctgcaccttgttacctgactttcggcttcaggatccgcagcgtgcacccgcgttccgtgagtgccctataggcagtcagcatgcccctctgcgtgtccctgtgttacggggacgccggctgggagccgcagagctatctcagaactagggcgctctcctttgggcacctccaggccattttcctttcattcgagcccacagggttagagataaaccctcactccgttgcttggggacaagggcttcactccctgtcccgagcttgcggctgagcttgagggtggctgggtcatcctggccccccactggatgggaattggctgctctggtgatttctgtgacatcccagaccccaactgtggggctctggagcggactgcgcttcacttcgtggggagggtgtttccacctaggccactcttatttctcttcacatccccagatctgtcttctgagactttgcccttctccaggaagagcactcaggagaccaggaaaatggccacagggctcctgagagccaaaaaagaggtgagaattaactgtaattctatcttggctgtcaacagaatgggtcccattaccttttcttgtcctggagctgccttgttggattgggcaaagtcattcctagccctagtcattcctagtccataaacaggangatttgatatantcttgtaaagcgkccgawtctgtccctgttaaggcgcncttgtanctgcncggacctggnggctgaccnaggattnnagaccnaaccnnnn

SEQ ID NO: 23368 - DNA, 1369 bp, Homo sapiens
  misc_feature 2, 9, 23, 26, 84, 1217, 1255, 1257, 1273, 1279, 1312, 1332,1368: n = A,T,C or G
gncgacagnagggcaaaacaggnagnatcattcaacaacccttctgattactcccctcataaagaaactcaagttccctggagnataattacagcagtggcgccaatctctggcaccatgtgcactgctgaymktwrkkaagtatgagttagggatgattgcgggggtgtctcccacctccattakagtgttaggaggagtaggcttgggacttattacattgctgtctcttggagccagtgcaatatttacccaataaatgtgattgaatttgtacaaagtcattgtctgcagccatctctgttaatgtgcatgttctgtaaaaaattgctcatgcatagacttagctttctattttaaatgtcacaattgagtcaataaagtaaacagagtttatgagtgtttacagttccaggaacacacaggggaatcctttattctgttttaaattaaagcgtcattcaaaaagaacaaactttcttaaatgttgcttttacatctttggctcagaacacagtatttctaactttgtttttcttattacttaggaaactagagaaatttctccttggaaatgtcagggggaaaatacagtatttcggattaactttagaaaactcaggtttaaggcttattgaccagaagacctctttcttatccaagtgtagggcaattcattgcaccttgaggtaggggaggagcaaaatcaggctggcaggggtccacggcagggcaagctctaggagctggtgagtctagaaggacggactagagagagctggcattggaatggacaatcgctagagggcgccggagcactagcagagtcaacctccgggacccataagcagggcttctaggataaggaatggagtttgacccaaccccaagatatgccctggggatattggttttctcaggtgcatctgactctccggcctggattgcctcgctgcggagaggggacaaaaggttttgccctragcatctggtgatgtcttccagtgcctggttaggttgctccgcggctggacagtctgactactctcaaaactcctcgtgacaggcctttctggggtctgatcgccctttgtttccttacmcttggrcctgttatcagaagaactctatcggaatccgkwawtammttggttyarwtttgrgswwcagtyttcrrgatccaggcatttgggtgaatcacttaacccgagtattangatctggaaaatggggctagtaattgttgtaatgtgangngttaaaagtgtctggnttttantgcgtaaataatgctactttctgtgcccttctnttggaggtctcccaacttcncccaaaaaaaaaaaaaaaaaaaccctgggccctttnc

SEQ ID NO: 23369 - DNA, 789 bp, Homo sapiens
  misc_feature 2, 9, 11, 23, 33, 756, 771: n = A,T,C or G
gnagacagnanggggcccggggnaggcagcaangcatcccggggaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaagcttaaggaataaacttttggttgcatattgatggatgtctcaccatggcccattttgtatcaggagaccraagaatatntcttatgatgtaaanagctttgggataagttat

SEQ ID NO: 23370 - DNA, 936 bp, Homo sapiens
  misc_feature 2, 5, 8, 10, 13, 15, 17, 18, 29, 40, 42, 60, 906: n = A,T,C or G
tnttnccntncgntnanncttgcttgttncttttggccgnancggcctacagctgcgagnagacgacagagggaaattacaaacacttgaaatatactgggattgtgtttattctctgtttagttasatagctgtattgaagtctctgtaaatgaaaaatttacccctatccctcaacatgtaggttgagaacagaaatattaatgggtgtgatttattaattcctgagggctattagcccatcaatagactacttcaaataaccattagtctcaatagtattgattaattccccaaatgcatttaaagcaatagtatatgaagtgcccttaagtgagcctcacgtttcctcattctacagataagaaaccaaggtacagagacaacaagtgacttatcccaagtcacacaggagttagaggcagggccaggacccaaacccaagtttcccttttatgagtcagctcatttcctgtgactccatattaaagatgccactctgaatttgccttggaagctggcgcttcagtttataacacaaattgacactttaggaagacaagagagctttgtattctccctgcaatcatttactcagtcaggaaaatactaaacactgtctttgcgtagaatataatgctactgatgtgaggaaaagaaatccagtgcctggcacatagaaaggatagatacccttttgtgggaggaaaacagtggaaaacatggactggagtctcagctctaccattactaattatgtgactttggtcaaatatttgaccctctgagacttgakttcacatctggaaatgtgaagaataaacactacttaatagaatattgggcaattaaattagkgtaaaagcttggttccagtaggagcaataaatgtccttctctaggaangggcatttctttacaagttttttctaagag

SEQ ID NO: 23371 - DNA, 1268 bp, Homo sapiens
  misc_feature 11, 22, 979, 1130, 1158, 1199, 1204, 1225, 1248, 1255, 1261,1265: n = A,T,C or G
cggctgctagnaagacgacagnaagggtagtacaagttccctggcccaccacaattagcattctctattgcaacaaacatatgaacatataaagaacaaggaaatacacacatacacacacatatgatgtttttagatggtaataagggctttagagattatgcaacagagctaaagggatcaggataccctggatggggtgggaagggaactgagaactctaagatgagaagaagccaattatgcagagaaccagggagagatattccagggctcagccatgcaggcccctggtgataagaagtttggcatatttgtagcattaagaacaagaggggagtgacagcagatgaggcctgtggggtagagaaaaactaacccattaagactagcctgccctgctcacatttctctcataattaaacacaatctatctggaccatccttaatttgcaaagcacagatagatctaaattttccttaattattatttcctctttggtggatttctgaaaagaagtgtgtgtgtgtgtgtatgtgtgtttgtgttcagacatctgcctatctatagctaagcttctgattaaccaagttttaatctatctacctcattgcgctttgctattttctctttctttatcctccaattgctccactaggtggggggtctggagggcaaacacattcattatgttgccagcaaacaagataggaattgcactgcaggggacaaaattaaatttacagctttcccttgtagatgtcataaactattgatttaacacaagaggagaaagctgcaatgatgggggcacaactgcagcgtatagctggactgtgtctggggagaggtcagcaatgactgccaacagccaagtccagacatctgagatcaactcctgcccacaggcaaagggtgaaagaagctagaccgtkgtatgcttgctataagagcaaaatttcaacctaaaagcrcggnctgctcagaatactatctgtacacctggatgaacattgctgattaatatggagagaacagattagtgaatgttacatcaagttcttggagtctttgacctgtgagggctttaaaagwacaagkgagagtcagctcaaaaagcaatacctgngaamctcttctctaatataaacaaktantcttttcttagacgcttgtgacccaaactwtwragatcttnccccnccttctgccgattgccggccnctcactagcctaaaaaaaaaccngcccttnacaaanaaantta

SEQ ID NO: 23372 - DNA, 804 bp, Homo sapiens
  misc_feature 591, 648, 650, 672, 704, 710, 761, 796, 797, 798, 799, 803: n = A,T,C or G
aagactcttcaccaggggaggatccggtggaatgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaaattagtgcactgaaaggctccaaaggaaaagactgggaaatccctgtgcctgtgggtatttcagtaactgatgaaaatggtaaaattataggagaactcagtaaagaaaatgacagaattttggtagctcaaggaggtcttggtggtaaattacttacaaatttcttaccattgaaaggccagaaacgaataattcaccttgatctaaaacttatagctgatgtaggcctagtaggattcccaaatgctggaaaatcctctttgctaagttgtgtttctcatgcaaaacctgcaattgcagattacgcatttacaacattaaagcctgaacttggaaagataatgtacagtgatttcaacagatatcagtagctgatcttccgggttaatagaaggasccattgamcaaggatgggccncaattcctcagcttagaagactaacactctttttgtgtgawwttctggattmrcttntntccctcatcagacactttgacntatctgttcaaaattgattgccaaagactcanaaactnctttgcgtataatgctgcaagccaaagtctgatgtaccctcaattaatttnttttaaaaaaaaaacctgccttctacctaatgtgnnnncccnc

SEQ ID NO: 23373 - DNA, 881 bp, Homo sapiens
  misc_feature 7, 9, 12, 14, 16, 17, 28, 39, 41, 48, 59, 62, 69, 854, 861,867, 874, 877: n = A,T,C or G
tttgggntncgntnanncttgcttgttncttttggccgnancggcctncggctgcgagnagncgacagnagggattcctcataattttttagagcacatacagcagttttatattacatggtttcgtaaatatttgttgtcttcttcattggatcgtaagctcctcaaggcmtagttcatgtctcgtttacttgccttgtaccctcaacctctgtcccagtccctagcacatagtgcccatgctacaaattccagaatgaatgaaaggatgaataaaggagtgagtgtttactatgattaagggactggactagttgtatattaaaatgataaatgtaagacacatcatctgctttcaagaagcatacagtctaccttgagccaggagtgaaagaaggagaacatatattataactagaatacagggcataaatgttatgtgataaatcataggtgaaaataaagcaatatagcaagagaagacattagttatttatagcataattttaatgggaaaatatacaagttttggaaacctgatttacaaactgaattttgcaacataatgtaagtggaaaaatgctcacttatgatttargtataacccttctataatgttcattcatttcaaaactggtatagaaatatattgttggctggggtgtgttggctcgtgcctataatcccacactttgggaggccagacaggtgggtcatctgtggtcagaagttctagaccmcctggcaacatggtgaaaccctattctattaaaatmcaaaattgtgggggcagtgcctgtagtcccacttctgggasctgagcaggagggtccttgacccagagcaaacttgcntggcaanacggcnctgtctntanccgg

SEQ ID NO: 23374 - DNA, 1147 bp, Homo sapiens
  misc_feature 178, 179, 383, 447, 978, 1041, 1043, 1110, 1119, 1128: n = A,T,C or G
ggggcagatatttaagtgataattacaatataatgtgataactacattcctagtaatactatgatattttgtgagcacggataatgtgttgctttaaaaagataatcagcttcataaactagattctaaattaacaagcacagtgctaacactcccctgactgaacagttatacaaannaggctaagggtcttagaatttattgtctttcttgctgaaagatgattctaataacaataaggttttccccctcctataattttgtgtttccaaaaacaaatggtgaggaaacaatagagtatgtttaccctttctggactcagggacagggtctctaatttggtctctgatttggacagctgctatttgccttagaccttttangttgtgtttctaaagactgaggctaaattgaacatgacagagaggattcaggtgaacagattanctcatctgtcttccaksagcacacctgttgcccccaacagaaggcagaaccatttctctttcaagcatgggctactgataaattcagctaggcgagctagttcagccttctcattaagggaagttaagagagaagtgrtgaaatcttaaaaattaggagtaactggacatttcgttaagggagatgcattacttcttacagcmctaggtatgagttgaagtcaatgcattttaaacrkggttttcctaaattgragtctttaaaaaataaaactttaagaaagtatcctaaatacatatggtraaaatttycacaaatactgctctttggccattcaagaaatcttcaaatgaaatatgatgttggaattttttctgcagcagttattctgatgtaatatacatctgccttattttttccatcactaattttttttcagtttgggtaataaaacttgttcatgaagcgtggtatatagaccatttttaaatggccctactccagtggacttcaagtccaaaatgcaatgangagttttcctaatggcaaatgtgcatcttttacatttttgtagcatggagggggaggcagtanangactgtggatgattttagctctgctctcaggcagagagcatcatggaaatgtgtccaactgctttangagctcctntgacttgcncgtacctcctttattcctg

SEQ ID NO: 23375 - DNA, 802 bp, Homo sapiens
  misc_feature 675, 682, 694, 709, 712, 729, 772, 773, 780, 787, 795: n = A,T,C or G
gggatctcttgcttggattattagtctctcaactggtctttctgtttccatccttcacaagagtgatcttgttaaaacagattattttatgtcatctcttcacttaagattctctgtgatgagttctttaccccactcagagtaaagtctaattagtgtaatactgtaccaggttctacagggtctggcctctcattccctctcagacttcatcttctatttgctctttctactcagttatggtcacactggcctctttgctgttcttgaccacacctgcacactcctgcacctgcacttttatacttcttgttgcctctgcttggattgctcttcccctgatgtagaactgtatgtgaacttagtctaagtaaaacaaaacaaatcctaacttaccctatttaatcatgcaatcttcctctttgagtctgtaacctgtatacctttttcatgttttattttttctccaaagccaattgtttgtctgttattatgtttctacttcctgctaggacacgttttgtcttgkttcttgktgtattactagcacttaacacaatgtctgactcatagtagatttactaaatgtttggtggataaaaggatgaatgaatttttcttaaatatttttgtttaccagttaacataacgatctgaarraggcatttgattggnggatcanggacttgaccangatagaggaaaaggncanaatttatttggggggcntactatttaagcaaaaaaaaaaaaaaaaacccgggcccttttnntaacccncttaaancttgagtnccccccc

SEQ ID NO: 23376 - DNA, 1022 bp, Homo sapiens
  misc_feature 943, 999, 1007, 1015, 1018, 1020: n = A,T,C or G
gggcacttaaaatgtgaatgaggggggcggggtgggggtggctataatgccagcactttgggaaggctgaggcagtaggattgctggaggccaggagtttgagaccagcatggccaacatagtgagaccccatctctacataaaataagaattataaaatgtaaagtgaatggaatgcattgaaatttgatcctgtagcaaagtcatcccttttgaattttgaacatttgtttaatgcctcttttccaagcatattttgaatattcagagataaatgagcaagttactgmcakcargraactcctattttkstaggagagwaaggggaaagacgtgtagttgtacacatatggtttgctctaatagagtggtataaatcaaatgctattggtatacaaaaggacaaattttgtcagccaagtgtatgggtatcttcaaagagcacaggtgccatctgttctgagctaatgacccattgaagaaggccacaccaaatttgggggaaaagcagcataaacaaatgccagagtattttccaggcaggttgtatttggagaatctcctaatgktgtatatttaatttgtcctttgtccaagaataatgcaatgaactaggcaactagttgaataaaaattgaaaccaagttcaaacaagcctattgaaaaatgggcaaaagactggaaaaacatggccaataagcgtaagaagagatgttcagcttgatcagtcatcaagaaactacaaatcarrmccwsrckgrggskggststgsyggmtcmwscytgkagcgakcccagcactttgggaggctgaagtgggcaaatcacttggacaggagttcaagaccagcctgggcaacatggtgaaaccctgtctctactaaaaatacaaaagttagctggcatggtggacacacctgtatccctgtactcgggggctgangcacagaatcccttgaactctggagagagaggtgcagtgagccgcatcagcactgnctcagatntcgatctnttntntc

SEQ ID NO: 23377 - DNA, 940 bp, Homo sapiens
  misc_feature 4, 7, 18, 22, 40, 51, 53, 72, 75, 746, 762, 794, 813, 826,834, 870, 922, 923, 933: n = A,T,C or G
attnccnctttgggtttnaatnaacccttttttttgtgtncttttggccgnancggcctacgkwmygsgcknacnagacassatgkgtwgttckkytggtycgatyckgyckmcggctkcramwacccgcgcmcrggmaggkraggcattccccgccttaatgcctcggtcaaacgtcgtccgaggtccgcttccaggcctcggcacctctgccccagggttgctggggtcggctgcggaacggaaatctctttatcatccgtgagaaaagttagagaggaagtgggttcctttgacagagcttactccagaagaaagacttgggtaggtccccggtaatcaagaagttcgtcggccctgaggaagagcctgaggcttggagggacgtcacccagctgttctggggcgcagtcggacctcaagtttctcacctctcaggccctggtattccgtgaacccgactgcgaaatgaagtctcttttccccagaaccaggaagtcaggccagcacctgacagatgcctgtggcgccagcagctcgctgagcctccacacgattgtaattcgcttgtttctccggcctccaagcttccagggaattagaaagtggaggcggcttatgggatcagatgagtacattcgcagatgggggaaaaaaagtgtacctgtcagcttggaagccagagggagacaaagggataaaagcaaaccctgtccaggtgcggtggctcatgcttgtaatcccancactttkggaggccangcgggcggatcgcttgaggtcaggagttcaanacagcctggccacatgggngaaaccctgtctntactaaanacaaattagctgcataatgcgggcgcccgatgccanctctccgggctgagcagaaatcctgaccagaggaaagttgatgacccaatcnncctccttcanctggcaa

SEQ ID NO: 23378 - DNA, 851 bp, Homo sapiens
  misc_feature 5, 11, 12, 15, 16, 17, 18, 30, 43, 44, 61, 70, 770, 801: n = A,T,C or G
ttttnacctannatnnnncttgtcttgttncttttggccgcanncggcccacggctgcganaacgacagnaaggggagttccgccgctgggactacagcgtttggctgcacggggagttctcgtatgtctagaacgatggcctttctgcggtgtctgcgaccgggaccaaggcggagcaaagtcgccgggggtgtggggtgttccacgctatgttgggagtgttcgctttcgaggtacatgactacgttctaaatttttttttttttgaaacagtttcattcttgttgcccaggcttgagtgcaatggtgcagtctccgctcacagcaacctccgccgcccgggttcaggcaattgtcccgtctcascctcccaagtagctggaattacaggcatgccccaccacccccggyttatttcgtatttttagtaaaaacgggtttccgcatgttggtcaggctggtctggaactcctgacctcaagtgatccacctggctcagcttaccgaagtgctgaaattccgggtgtgagccaccgcgcctagccctctaaacttttaaataatcgkgaaatgtatgcccagctgaagcaaattcasctatttcctctaccttttggggggaatttaaaatactgaacttgkgaaatgaacctggkgggcaccagttctcaaacttyttggtcacaggacgcttgccctctcttaaaatgtactgaggacacctaaaasctttgctcactggkggttactactgctttttactacctanaaataamcttttaaatttttccttaaaaacncccacctaacataagttttttttwttaaaaatctttcaaaaaaaaaaaaa

SEQ ID NO: 23379 - DNA, 875 bp, Homo sapiens
  misc_feature 2, 3, 12, 13, 17, 21, 32, 43, 45, 815, 823, 846, 849, 853,854, 855, 864, 869: n = A,T,C or G
anntcttggggnnaaanacancttttttgttncttttggccgnancggcctaggctagggataatatgttttaatcattttgggtgttttcaaaacaaatggtgagattaggggttttttttctcttctatttttggcccctttcctctggagagtccttctcttgtgtttagttcttggtgttcttagtatatttgaagaatgcttttaagtatttgaaatgtgtgtacatggttgaaaggggatgaggaagaagaaaccgaaaacttcatgaccctgctcaaaccaatacccataccccagccctaaagcagtgtccgggcaccacatcttcaaggaaggccccttggaaacccctcatgggccagtcctctgacccaggtgatctcctaaccccctttatgtattcttatgaggatatatgataaagaacggactgtgagatttgttgttcaaatttttccccttagaatgtgagctcagtgggtaatagtaccatgttggctctgtccacagttctactatcttcagcatagggcctggtatacagtaagcgcttaaaaaatacatgtcaaatggctgggtgcagtggctcacacctgtaatcctagcactttgggaggccgaggcgggtggatcatgaggtcaggaattcaagacccacctggccagatggggaaatcccatctctactaaaatacaaaattagccgggcatggtagcaggtgcctgtatcccagctctaggrrgctgagcaaaawkgcttacccggagsaaagggcaggcccaatctgtccaacctttaccggcacaanaaaattgncaaaaaaaaaaaaacccgggccnttncctnnncaattaaantttgnttgacc

SEQ ID NO: 23380 - DNA, 951 bp, Homo sapiens
  misc_feature 2, 11, 25, 32, 46, 48, 55, 57, 809, 865, 869, 871, 876, 893,897, 905, 918, 921, 932, 943, 944, 946, 948, 950: n = A,T,C or G
tnttttgaccnaaaaacccaccttncttgttncttttggaccgcangnagacagnangggtgacttggccaagtaacacaacctgcctgaccctctggccatgcacacgtgtggagtttgttcccgggccctgtgcctgttcaaagaatggctggacgtcggtattgcccttggtttctgccctgaagtccagtcagtcagcagttctgcttattctgaccctctctgtgcagtattacccaacacacatgcatttcctccttgccttctcagtattgccatcgtgaaccagaattgtcacctccaatttaaacagtgaaggcctttgttaggaagagggacagcaaggggsrkgrttgctttttctaaatcacagctctgatcaaatccctcctaagcagaagccttccaggctcccctccataaggctccaggtgtttacttaccttgcctgtcaggggcttctgcagcttgcttcctacctgctatctccactcctctccaaaccaccatatcctgaggcttctagaaagcaaactctggcggcatggggttaatgggtctgtgtacccaagacactgtacctgggtgctgtcatctgcctgactgaccttcctgtgtcctggtccgatggtgtctttgatcctatagctaagatcaagacactgaaaatctctagactcaagtctgtgcttttgctgggataaagtttgtgttgagtacatctaggctgggygtggkagctcacgcctgtaatctcagcactttgggaggccaakgcaggtggatcatctgaggtcaggagttcnagaccagcctggacaacatggtgaaaccctgtctctgctaaaaatacaaaaattanccangngtggnggcaggcgcctgtaatnccanctactcangaggctgaggcanganaatcccttgancctgggaggcnnangntnc

SEQ ID NO: 23381 - DNA, 897 bp, Homo sapiens
  misc_feature 814, 818, 820, 825, 828, 832, 833, 839, 845, 848, 855, 870,873, 878, 880, 884, 887, 890: n = A,T,C or G
agcgcgtcagctgattggcaataggctgacggtggggggagtagataggggaggcagatgcagttggtgggtatggctggtacttccaaatacagccaaagtttatgcacttaacatgtattaggcacagcgctaattactataagtgattgatttgacttccccacatctttatgaagttgagtatgttattcctttccctcttttatttacwtwtckwtkwmytwwyawwyyyttmkwgwcwtgktcytgctwtgkwscgcagtskgggctcaaacttctggccttgagtgattctctcacctcagactcctgagtagctgggattacagatgcgggccaccacacctggctgtacaaactttaaaatgtttgagcaaattcaatgagtatagtaaaatatcttcctccctttaccgattcccaccctattctcccccacccccaccccaggcatcaatattatggtttcttgtgcactgagtgattttttaaattattattattttttwatttttgagacagagtctctctctgtyacccaggctggagtgcagtggtgcgatctcagctcactgcaacctycgcctcccgggttcaagcaattctcctgcctcarcctcctgagtagctgagactacgggcgcccgccaccatgcctggctatttttttgtatttttagtagagatggggtttcacccgagatggtctcaatctcctgacctgatgatccgcctgccttggcctcccaaagtgctgggattacaggcgtgagccaccgcgcctggcctattttttttttttttttaaatnatananggggnctntgcnnccaggntggagngcnggggcancccccaactcctganctnaggcngncctnccncanagcctac

SEQ ID NO: 23382 - DNA, 978 bp, Homo sapiens
  misc_feature 908, 918, 921, 922, 925, 926, 927, 928, 929, 944, 947: n = A,T,C or G
gggaagattattccattttgttaagattaaaaatgagcagtcaaataattctttctctgagagaagagtgtatggtaggtccattgagggtgtctgttgtatcttaaaatctattcgaaatgtttgggtgaattattgtctaaattgacagatgattgcttttgagctaacaaaatatttctgttagcatagctaaagaatatatgttaaggaatatatgctctttgtaagttttgattgagtagataagaygatacagacaggggaatcaggaaacaaatcaacaatcaactggaattacaaccaaatctatgtacttctgttgtgagatctttttacttgcaatcctttgcaaaacgtgctgtgcacaatgtagtaagtatgcttgtaataaacaattaaaggagcttttcacgtgtagaagtgcacgcttaatttttgttaaatcatctcaataaatacttataagtgaagccaacatgattttcttaagttttttgaaaatgtgtgtacctataactgctgtgctatttgcaagaggcagtatacacacaaatttgatgatttcattctttaccaaatactatatttagcacattaaatactaagaaatagcactaaaatgggccgggcctggtggctcatgcctgtaatcccagcactttgggaggccgtggcagacggatcacttgaggtccagagtttgagaccaacctggccaacatggtgaaaccccgtctctactaaaaatacaaaaattgctggscykggtggtggatgcctgtaatcccagctactcgagaagcttgggcaggagaatcacttgaactcaggaggcgggaggttgcagtgagctgaaattgtaccactgcactccagcctgggcataaaagcgaaactcmcctcanaaaaaaaaanaannccnnnnnaaaaaaaaaaaaggnggnggaaaaaaaaaaaaaaaaacccccggccctt

SEQ ID NO: 23383 - DNA, 898 bp, Homo sapiens
  misc_feature 11, 15, 18, 30, 41, 43, 50, 59, 61, 64, 72, 771, 794, 796,870, 871, 872, 874, 891, 895: n = A,T,C or G
ttttttccgtncganaanccttgcttgttncttttggccgnancggcctncggctgcgnanagnacgacagnagggatacacatatttaataaatagtacactgtactatggaaggatgagataaaatattatggaagcattagagagaaagagagaatttccaatctatgggtatcataggtggtttcttggaggaaagtggaactgaactaagcctcgaagttggtaaggaacagatggttggctatggtagggtggagaaaagcagagttgcagaattctcttatgttgtagtcccaaattaatagtaatgtactagattttcttctcctctcttgtgaatttccagcaacagcttgattttaacctccacagaaacacaaatgagagctgtgatggaaacaataattactagagtccagttttaactccaagtcaaaattttagtcacattcagccctgaataagaaataaggcaaagcatgcaacaggactttataactttttaattttaaggcattataaatataaatttttattttatcttatttttttagagatggggtcttgctctgttgcccagacaggagtgtagtggcaccttcttagcttactgcagccttgaactgttgggctcaagcgatccttctgcctcagcctgctgagtatgaggatgccaaggcmtaagaatgacacatggactttaggactcagggggaaarggtgtgagggataaaaactccaattgtgkgcagkgtatactgctcagngtgagtgccccaawctccaatcncnctaagactactctgtaccaaccccctgttcccataccttgaaaaaaaaaaaaaaaaaaaccctggcccttttcnnnanccactgaaaaacttgtngtgnccc

SEQ ID NO: 23384 - DNA, 745 bp, Homo sapiens
  misc_feature 13, 35: n = A,T,C or G
ttttaattatggntagctgtctcaaagcataaaanggaataacatatcaaatgaaacagggaaaatgaagctgacarkktatggaagccagggcttgtcacagtctctactgttattatgcattacctgggaatttatataagcccttaataataatgccaatgaacatctcatgtgtgctcacaatgttctggcactattataagtgcttcacaggttttatgtgttcttcgtaactttatggagtaggtaccatttgkgtctctttattataagtgagagaratgaagtttatattatcaaggggactaaagtcacacggcttgtgggcactgtgccaagatttaaaattaaatttgatggktgaatacagttacttaatgaccatgttatattgcttcctgtgkaacatctgccatttatttcctcagctgkacaaatcctctgktttctctctgttacacactaacatcaatggctttgtacttgkgatgagagataaccttgccctagttgkggcrcaayacatrmaraayaatcctgttttacagctgcctttcgtgatcttattgcttgcttttttccagattcagggagaatgttgttgtctatttgtctcttacatctccttgatcatgtcttcattttttaatgtgctctgtacctgtcaaaaattttgaatgtacaccacatgctattgtctgaacttgagtataagataaaataaaattttattttaaatttt

SEQ ID NO: 23385 - DNA, 795 bp, Homo sapiens
  misc_feature 9, 12: n = A,T,C or G
aggtagggnagnaagcgctgttccttctggctgggaagtgcgagccggtggggggagagagaggagtagagcattatgtggaggtacttcccggttcccttgcgtctgagggtcttatgccagaggggatagaaagcccaacagaaactcaagatagaagaaggagaatctgcgagtgtctgtctcctgtcaagcttccctaatacagccctggtagaacttcatcaacagtggaaggcatttgcaaaggtgagcccaaaccagcacccctttccacacaggctgtccatgtagaaggcccagatgcttctcagggtctctgagaggatacaaagctactgagggggccagagggcacagcacctgggatttggatgagaagctgcaggaagggaactttgcaccccaagggcatggtgtggagtcaatagtggcaagttcagtctggttttttacatcagccggttcagaggaagagtgaaatccccaagatcagcagggcaaaatgctggaagttgtcgaggatgcagagagtagcaggaagacacctctgagaactcactcacacaccctgcccctgtgtagagatgtcatcctggggatgagaaggaggaagacagagaaacgcagaaaagcctaagcaggcaccacaaagagaccgagcccgtctgaaagaggctgctctaacctggtggaaactwttttagttgccaccagacattacattccaagccttgaaaaaaastgaaaaaaaaaarycytgaaaarrcycttctyacaawracacmtwrtggg

SEQ ID NO: 23386 - DNA, 6111 bp, Homo sapiens
atggtggccaaagtggatgaggtgaagtccacaacccagtttcagatgaagaaggtgctatgtctggctgtggctgttggccatgtgaagatgacagacgatgagcttgtacataacattcacctggctgtcaacttcctagtgtcattactcaagaaaaattgccaagacattcaagctttatatactgagagcaccgtgggcaagcccacgtgcctgcacattctaataaattctactgccaccaaagcaaaacaaaacaaaataaaaacaataaagagaaattatctggaagctgagtatgaaatgtggtatcaggattcttcaattcattccaattttctgaaatccattagatacagtgcaaccaaactatgctcagtggccactgggacagatagaaaattctataactggatacattcggggaggagccaagatggccgaataggaacagctccggtctacagctcccagcgtgaccgacgcagaagaccggtgatttctgcatttccatctgagacctgcagctgagggtcctgtctgttagaaggaaaactaacaaacagaaaggacatccacaccaaaaacccatctgtacatcaccatcatcacagaccaaaagtagataaaaccacaaagatggggaaaaaacagaacagaaaaactggaagctccaaaaatcagagcgcctctcctcctccaaaggaacgcagctcctcaccagcaacagaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtgtcagcaatggaagatgaaatgaatgaaatgaagcgagaagggaagtttagagaaagaagagtaaaaagaaatgagcaaagcctccaagaaatatgggactatgtgaaaagaccaaatctacatctgattggtgtacctgaaagtgatggggagaatggaaccaagttggaaaacactctgcaggatattatccaggagaacttccccaatttagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcagcagaaaccctacaagccagaagagagtgggggccaatattcaacattcttaaagaaaagaattttcaacccagaatttcatatccagccaagctaagcttcataagtgaaggagaaataaaatactttacagacaagcaaatgctgagagattttgtcaccaccagacctgccctaaaagagctcctgaaggaagcgctaaacatggaaaggaacaacccgtaccagccactgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttttagcactaaatgcccacaagagaaagcaggaaagatccaaaattgacaccctaacatcacaattaaaagaactagaaagcaagagcaaacacattcaaaagctagcagaaggcaagaaataactaaaatcagagcagaactgaagaaaatagagacacaaaaaacccttcaaaaaatcagtgaatccaggagctggttttttgaaaggatcaacaaaattgatagaccgctagcaagactaataaagaaaaaaagagagaagaatcaaatagacacaataaaaaatgataaaggggatagcaccaccgatcccacagaaatacaaactaccatcagagaatactacaaacacctctacgcaaataaactagaaaatctagaagaaatggataaattcctcgacacatacactctcccaagactaaaccaggaagaagttgaatctcttaatagaccaataacaggagctgaaattgtggcaataatcaatagcttaccaaccaaaaagagtccaggactagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccatagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactttactacaaggctacaataaccaaaacagcatggtactggtaccaaaacagagatatagatcaatggaacagaacagagccctcagaaataacgccgcatacctacaactgtctgatctttgacaaacctgagaaaaacaagaaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcagaacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaccaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacattgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattcttagtaaactatcacaagaacaaaaaaccaaacaccgcatattctcactcataggtgggaattgaacaatgagatcacatggacacaggaaggggaatatcacactctggggactgtggtggggtagggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaaaaaaagaaaagaaaattctataactggccaggcgcggtggctcatgccagtaatcctagtactttgggaggctgaggtgggcgggtcacgaggtcaggagattgagaccatcctggctaacagggtgaaaccctgcctctattaaaatacaaaaaattagccaggagtggtggcacgtgcctgtagtcctagctacttgggaggctgaggcaggagaattgcttgaacctgggaggcggaggttgcagtgagccgagatcgcaccactgcactccagcctggcgacagagcgagactcggtctcaaaaaaaaaaattttataactaatgtggaaacagttttatga

SEQ ID NO: 23387 - DNA, 612 bp, Homo sapiens
atgtcttactacctcagctcagaaaaccacctggacccagggcccatctacatgcgagaaaatgggcagctgcacatggtcaatctggctctggatggtgtcaggagtagcctgcagaagccaaggcctttcagactgttccccaaaggcttttctgtggagctttgcatgaacagggaagacgacactgcacggaaagagaagactgatcatttcatcttcacatacacccgagaggggaatcttcggtactccgccaaatccctcttcagccttgtcctgggtttcatctccgacaatgtggatcacattgattcccttattggctttcctgagcagattgctgaaaagctgttctctgctgctgaagccagacagaaattcactgagccaggtgcagggctgagggctttacagaaattcactgaggcctatggaagtttggtgctttgctccctgtgtttgcgaaacaggtatctcgtgatttcagaaaagcttgaggagattaagtctttccgggagctgacctgcctggatctttcctgttgcaagcttggagatgagcatgaacttctagaacatctcaccaatgaagccctgtctaggtactga

SEQ ID NO: 23388 - DNA, 2181 bp, Homo sapiens
atgaagcagatgacatttgaagcccaagcctttttagaagctgtgcaattcttccgacaggagaagggtcactatggttcctgggaaatgatcactggggatgaaatccagatcctgagtaacctggtgatggaggagctcctgcccactcttcagacagacctgctgcctaagatgaaggggaagaagaatgacagaaagaggacgtggcttggtctcctcgaggaggcctacaccctggttcagcatcaagtttcagaaggattaagtgccttgaaggaggaatgcagagctctgacaaagggcctggaaggaacgatccgttctgacatggatcagattgtgaactcaaagaactatttaattggaaagatcaaagcgatggtggcccagccggcggagaaaagctgcttggagagtgtgcagccattcctggcatccatcctggaggagctcatgggaccagtgagctcgggattcagtgaagtacgtgtactctttgagaaagaggtgaatgaagtcagccagaacttccagaccaccaaagacagtgtccagctaaaggagcatctagaccggcttatgaatcttccgctgcattccgtgaagatggaaccttgttatactaaagtcaacctgcttcacgagcgcctgcaggatctcaagagccgcttcagattcccccacattgatctggtggttcagaggacacagaactacatgcaggagctaatggagaatgcagtgttcacttttgagcagttgctttccccacatctccaaggagaggcctccaaaactgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaagtgataaaggaagctgctatcttgaagaaacacaacttatttgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgggccaagcccacccccagatgggactgagcaggtgattatttcaagagtggatgaccccgtggtgaatcctgtggcaacagaggacacagcaggactcccgggcacatgctcatcagagctggagtttggagggacccttgaggatgaagaacccgcccaggaagagccagaacccatcactgcctcgggttctttgaaggcgctcagaaagttgctgacagcgtccgtggaagtaccagtggactctgctccagtgatggaagaagatacgaatggggagagccacgttccccaagaaaatgaagaagaagaggaaaaagagcccagtcaggcagctgccatccaccccgacaactgtgaagaaagtgaagtcagcgagagggaggcccaacctccctgtcccgaggcccatggggaggagttggggggatttccagaggtaggcagcccagcctctccgccagccagtggagggctcaccgaggagcccctggggcccatggagggggagctcccaggagaggcctgcacactcactgcccatgaaggaagagggggcaagtgtaccgaggaaggggatgcctcacagcaagagggctgcaccttaggttctgaccccatctgcctcagtgagagccaggtttctgaggaacaagaagagatgggagggcaaagcagcgcggcccaggccacggccagtgtgaatgcagaggagatcaaggtagcccgtattcatgagtgtcagtgggtggtggaggatgctccaaacccggatgtcctgctgtcacacaaagatgacgtgaaggagggagaaggtggtcaggagagtttcccagagctgccctcagaggagtga

SEQ ID NO: 23389 - DNA, 882 bp, Homo sapiens
atgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaaggtaagcttgggaccctggttagtggtgtatttatttatttttgctttgtttagtaaatatttaatagatacaaagaattttttttttgagacagtctcactctgtcacccaggctaaaatgcagtggtgtgatctcagctcactgcaacctccagctccctggttcaagcaattcccctgcctcagcctcccgagtagctgggattacaggtgtacgccaccacacccggctaatttttttgtatttttaatagagatggggtttcgccatgttggccagactggtctcgaactcctgacctcaggcaatccaccccacttggcctcccaaagtgctgggattacaggcgtgagccaccgcacccggccacaaagaaatatttttaa

SEQ ID NO: 23390 - DNA, 1746 bp, Homo sapiens
atgaagctctccctggtggccgcgatgctgctgctgctgctcagcgcggcgcgggccaaggaggaggacatgggcacggtggtcgccatccacctggggacaacctacccctgtgtcggcgtgttcaagaacggccgcatggagatcatcgccaacgatcagggcaaccgcatcatgccgtcctatgtggccttcactcctgaaggggaatgtctgatcggcgatgcagctaagaaccagctcacctccaaccccaagaacacggtctttgacgccaagcggctcatcggccgcaggtggcacgacccgtctgtgcagcaggacatcgagttcctgccgttcaaggtggttgaaaagaacactaaatcatacattcaaattgatgttggaggtgggcaaacaaagacatttgctcctaaagaaatttctgcaatggttctcactaaaatgaaagaaaacgctgaggcttatttgggaaaggttacccatgcagttgttactgcaccagcctatttcaatgatgcccaatgccaagcaaccaaggacgctggaactattgctgacctaaatgttatgaggatcatcaataagcctacagcagctgctattgcttatggcctggataagagggagggggagaagaacatcctggtgtttgacctgggtggtggaacctttgatgtgtctcttctcaccattgacaatggtgtcttcaaagttgtggccactaatggagatacttatctgggtggagaagactttgaccagcgtgtcatggaacacttcatcaaactgtacaaaaagaagactggcaaagatgtcaggaaagacaatagagctgtgcagaaactctggcgcaaggtagaaaaggccaaacgggccctgtcttctcaacatcaagcaagcttggaagactctgatttgaagaagtctgacattgatgaaactgttcttgttggtggctttactcaaattccaaagattcagcaactggttaaagagttcttcaatggcaaggaactatcccgcggcataagcccatatgaagctgtagcatatggtgctgctgtccaggctggtgtgctctctggtgatcaagatacaggtgacttggtgctgcttgatatatgtccccttacacttggtattgaaactgtgggaggtgtcatgaccaaactgattccaaggaacacagtggtgccaaccaagaagtctcagatattttctacagcttttgataatcaaccgttacaatcaaggtctatgaagattgaagtcacctttgagatggatgtgagtgatattcttcaagtgacagctaaagacaagggtacaaggtacaaaaataagatcacaattaccaacgaccagaatcacctgacacctgaagatattgaaaggatggttaatgatgctgagaagtttgctgaggaagacaaaaagctcaaggagtgcactgatactagaaatgagttggaaagctatgcctattctctaaagaatcagattggagataaagaaaagctgggaggtaaactttcctctgaagataaggagaccatggaaaaaactgtagaagaaaagactgaatggctggaaagccaccaagatgctgacactgaagacttcaaagctaagaagaaggaactggaagaaattgttcaaccaattatcagcaaactctatggaagcgcaggccctcccccaactggggaagaggatacagcagaaaaagatgagttgtag

SEQ ID NO: 23391 - DNA, 3786 bp, Homo sapiens
atggtggtatcagccggccattggtccagtgagaaggcagagatgaacattctagaaatcaacgagacattgcgcccccagctggcagagaacaaacagcagttgagaaacctcaaagagaaatgttttctaactcaactggccggcttcctggccaaccgacagaagaaatacaagtatgaagagtgtaaagacctcataaaatttatgctgaggaatgagcgacagttcaaggaggagaagcttgcagagcagctcaagcaagctgaggagctcaggcaatataaagtcctggttcactctcaggaacgagagctgacgcagttaaaggagaagttacgggaagggagagatgcctcccgctcattgaatgagcatctccaggccctcctcactccggatgagccggacaagtcccagggacagaacctccaagaacagctggctgaggggtgtagactggcacagcaccttgtccaaaagctcagcccagaaaatgacgaagatgaggatgaagatgttcaagttgaggaggctgagaaagtgcggaaatcatctgcccccagggaggtgcagaagactgaagagagcaaagtccctgaggactcactggaggaatgtgccatcacttgttcaaatagccacggcccttgtgactccaaccagcctcacaagaacatcaaaatcacatttgaggaagatgaagtcaactcaactctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaaattgcacccccagctggcagagaagaaacagcagttcagaaacctcaaagagaaatgttttctaactcaactggccggcttcctggccaaccgacagaacaaatacaaatatgaagagtgcaaagatctcataaaatctatgctgaggaatgagcgacagttcaaggaggagaagcttgcagagcagctcaagcaagctgaggagctcaggcaatataaagtcctggttcacgctcaggaacgagagctgacccagttaagggagaagttgcgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgacaacgatgacgatgaagatgttcaagttgaggtggctgagaaagtgcagaaatcgtctgcccccagggagatgcagaaggctgaagaaaaggaagtccctgaggactcactggaggaatgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattattccagaaaatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttggcctcgtacaagtcttacagcagcacatttcactcattagaggaacagcaagtctgcatggctgttgacataggcagacatcggtgggatcaagtgaaaaaggaggaccacgaggcaacaggtcccaggctcagcagagagctgctggatgagaaagggcctgaagtcttgcaggactcactggatagatgttattcaactccttcaggttgtcttgaactgactgactcatgccagccctacagaagtgccttttacgtattggagcaacagcgtgttggcttggctgttaacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaagcatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcagcagggagctgctggatgagaaagggcctgaagtcttgcaggactcactggatagatgttattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcggggagctgttggatgagaaagagcctgaagtcttgcaggagtcactggatagatgctattcaactccttcaggttgtcttgaactgactgactcatgccagccctacagaagtgccttttacatattggagcaacagcgtgttggcttggctgttgacatggatgaaattgaaaagtaccaagaagtggaagaagaccaagacccatcatgccccaggctcagcagggagctgctggatgagaaagagcctgaagtcttgcaggactcactgggtagatgttattcgactccttcaggttatcttgaactgcctgacttaggccagccctacagcagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggagaaattgaaaagaaggggaaggggaagaaaagaaggggaagaagatcaaagaaggaaagaagaaggggaagaaaagaaggggaagaagatcaaaacccaccatgccccaggctcaacagcatgctgatggaagtggaagagcctgaagtcttgcaggactcactggatatatgttattcgactccgtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataa

SEQ ID NO: 23392 - DNA, 687 bp, Homo sapiens
atggctgtagctagtgcactacaatttcctaaaaagtcttgtcactctcataggactgctctacatctggcctctgccaatgggaattcaggagtagtaaaactcctgctggacagacgatgtcaacttaatgtccttgacaacaaaaagaggacagctctgacaaaggccgtacaatgccaggaagatgaatgtgcgttaatgttgctggaacatggcactgatccaaacattccagatgagtatggaaataccactctgcactacgctatctacaatgaagataaattaatggccaaagcactgctcttatacggtgctgatatcgaatcaaaaaacaagcatggcctcacaccactgctacttggtgtacatgagcaaaaacagcaagtggtgaaatttttaatcaagaaaaaagcgaatttaaatgcgctggatagatatggaagaactgctctcatacttgctgtatgttgtggatcagcaagtatagtcagccttctacttgagcaaaatattgatgtatcttctcaagatctatctggacagacggccagagagtatgctgtttctagtcatcatcatgtaatttgccagttactttctgactacaaagaaaaacagatgctaaaaatctcttctgaaaacagcaatccagaaaatgtctcaagaaccagaaataaataa

SEQ ID NO: 23393 - DNA, 708 bp, Homo sapiens
atggcctcaaataaagccaccatagctaaagccaatggagagaaggagaggaatgcaagctggagtggtgtgagaggaggcttaatgcagcatcaggaatttcaacagtgtccaatagtaacaaagccagacaccctcagtgtcaatataggacacatgggagatggtaaaaaggcattcctctccctcccagccaggggtaaatacaaggtattcttagagtttgtaggttctgtacataactatgatgtagaagtgacagttattgagaaagaaaagagtatgtttcttccaaacaaggcatctaaactcaacttgaaacgtgaattattgaagcataaaggagaattcaagaatgcagtttatttgtctggcatctctatggggcctgaatatgatgatttaattgctcattttgattattgtcagcagaagtaccagtgtagtcaactgggtatggcaagaattctaacaatcactgagaacaggagtacagatgactctaaacacttcacattttcagggcatctccatactcacctacaagcattcgaaagaatggcctctagtagtcacactagacactggccacaagagccttgtaccacttctgttttattggatttctctagagctgaacttctccttcctaatcagttgctcacaagactcaggaactgcttgcctcaagacagccggctgatttag

SEQ ID NO: 23394 - DNA, 2936 bp, Homo sapiens
atggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcgggtaatatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatag

SEQ ID NO: 23395 - DNA, 811 bp, Homo sapiens
atggactcagaactcaaggaagaaattcctgtgcatgaggaattcattttgtgtggtggagccgaaacccaggttctaaaatgtgggccctggacagacctctttcatgatcaaagtgtcaaaaggcctaagctgcttattttcattattcctggtaacccaggtttttctgccttttatgtgccatttgcaaaggctttatactctttgacaaacagacgctttccagtttggactatcagtcatgctgggcatgcgttggctcccaaagacaagaagattcttacaacatcagaggattcaaacgctcaagaaattaaggacatttatggactaaatggacaaatagagcacaaactagctttcctgagaactcatgtgccaaaggacatgaaacttgtgctcattggccattcaataggcagctatttcacacttcagatgctgaagcgagtccctgagctcccggtaattcgtgcctttctgctctttccaacaattgaacgaatgtctgagtcacccaatggcagaattgccactccacttttgtgctggtttcgatatgttctctatgttactggctacttattattgaaaccgtgtcctgagacaatcaagtccttgctaatcagaaggggccttcaagtaatgaacctagagaatgaattttcaccattgaatatattagaaccattctgccttgctaatgctgcctaccttgggggccaagaaatgatggaggtggtgaagagagatgacgaaaccataaaggagcatttatgtaagcttacattttattatggtactatag

SEQ ID NO: 23396 - DNA, 1728 bp, Homo sapiens
atggtacttggatcatttggaacagacttaatgagagagaggagagatttggagagaagaacagattcctctattagtaatcttatggattatagtcaccgaagtggtgatttcacaacttcatcatatgttcaagacagagttccttcatattcacaaggagcaagaccaaaagaaaactcaatgagcactttacagttgaatacatcatccacaaaccaccaattgccttctgaacatcagaccatactaagttctagggactccagaaattctttaagatcaaatttttcttcaagagaatcagaatcttcccgaagcaatacgcagcctggattttcttacagttcaagtagagatgaagccccaatcataagcaattcagaaagggttgtttcatctcaaagaccatttcaagaatcttctgacaatgaaggtaggcggacaacgaggagattgctgtcacgcatagcttctagcatgtcatctacttttttttcacgaagatctagtcaggattccttgaatacaagatcattgaattctgaaaattcttacgtttctccaagaatcttgacagcttcacagtcccgtagtaatgtaccatcagcttctgaagttcccgataatagggcatctgaagcttctcagggatttcgatttcttaggcgaagatggggtttgtcatctcttagccacaatcatagctctgagtcagattcagaaaattttaaccaagaatctgaaggtagaaatacaggaccatggttatcttcctcacttagaaatagatgcacacctttgttctctagaaggaggcgagagggaagagatgaatcttcaaggatacctacctctgatacatcatctagatctcatatttttagaagagaatcaaatgaagtggttcaccttgaagcacagaatgatcctcttggagctgctgccaacagaccacaagcatctgcagcatcaagcagtgccacaacaggtggctctacatcagattcggctcaaggtggaagaaatacaggaatatcagggattcttcctggttccttattccggtttgcagtccctccagcacttgggagtaatttgaccgacaatgtcatgatcacagtagatattattccttcaggttggaattcagctgatggtaaaagtgataaaactaaaagtgcgccttcaagagatccagaaagattgcagaaaataaaagagagcctccttttagaggactcagaagaagaagaaggtgacttatgtagaatttgtcaaatggcagctgcatcatcatctaatttgctgatagagccatgcaagtgcacaggaagtttgcagtatgtccaccaagactgtatgaaaaagtggttacaggccaaaattaactctggttcttcattagaagctgtaaccacctgtgaactatgtaaagagaagttggagcttaacctggaggattttgatattcatgaactacatagagctcatgcaaatgaacaagctgagtatgagtttatcagctctggtctctacctagtggtgttattgcacttgtgcgaacaaagcttttctgatatgatgggaaatacaaatgaaccaagcacacgtgtccgatttattaaccttgcaagaactcttcaggcacatatggaagatctcgaaacttcagaggatgattccgaagaagacggagaccataacaggacatttgatattgcctaa

SEQ ID NO: 23397 - DNA, 591 bp, Homo sapiens
atgattttaatattctgtacatttattattgatttaaaatgcattttacctttttctttaatagatgttggaatttctgatgaatctgcagtcagcattttgcatgaactgtgtgtggattcattgcctacattggatgatgaagacttgagtgttgctactaagcagtgtgtccctgagaaagtgtcagagcctttacgtggaccttctcatgaaaaaggaaacagaatagtcaatggaaaaggaaaaggtgagaaccgtattttatttaaaaagtcatttgatggaggccaggcgcggtggctcacgcctgtaattccagcactttgggagcccgaggtgggcgggtaatgaggtcaggagatcaagaccatcctggctaacatggtgaaaccccatctctactaaaaacacaaaaaattagccgggcatggtggcgggtgcctgtagtcccagcaactcgggaggctgaggcaggaggatggtgtgaacctgggaggtggagcttgcagtgagcggagatcgtgccactgcactccagcctgggtgacagagtgagactccatctcaaaaaaaaaaaaaaggcattga

SEQ ID NO: 23398 - DNA, 720 bp, Homo sapiens
atgcaggaccccaacgcagacactgaatggaatgacatcttacgcaaaaagggtatcttaccccccaaggaaagtctgaaagaattggaagaggaggcagaagaggagcagcgcatcctccagcagtcagtggtgaaaacatatgaagatatgactttggaagagctggaggatcatgaagacgagtttaatgaggaggatgaacgtgctattgaaatgtacagacggcggagactggctgagtggaaagcaactaaactgaagaataaattcggagaagttttggagatctcagggaaggattatgttcaagaagttaccaaagctggcgagggcttgtgggtcatcttgcacctttacaaacaaggaattcccctctgtgccctgataaatcagcacctcagtggacttgccaggaagtttcctgatgtcaaatttatcaaagccatttcaacaacctgcatacccaattatcctgataggaatctgcccacgatatttgtttacctggaaggagatatcaaggctcagtttattggtcctctggtgtttggcggcatgaacctgacaagagatgagttggaatggaaactgtctgaatctggagcaattatgacagacctggaggaaaaccctaagaagccgattgaagacgtgttgctgtcctcagtgcggcgctctgtcctcatgaagagggacagcgattccgagggtgactga

SEQ ID NO: 23399 - DNA, 597 bp, Homo sapiens
atgagagtttcagatactgagaatagaaccactaagaagcagaaaagagaagatattctcgtgggggagaacaacggctgggaggggaggaagcatggccaaggcaaagaggtgggcattaataagctttgtaacctgctcctgcttcagtgtcctcttgctttgcctgcttttgaaagaaggaaaagaataaaacaccgaacttatgatgacactgattttacattaaaatctggggctgaagttgagacatgtgaagtgtttgatgtaatatcttatttcaggaatataccaatggcttataattccaagatgatttcagttgacaagctgggagagaggcacagtgagaaacagcctgttccacccacaatgaccgccactgctttaaactgcattttgcattttggtgattctgatggctatattgatatgagtctgtgtggaaagttcctgctgcagataactgagtgtaggctcagagaggtgcggtgtgggacagagaaagggaaaaaaccctttcttcacactcgtgctgctctgaatgcggaccatctgtgcccccagctggagcgccggcaatggtctggcacttga

SEQ ID NO: 23400 - DNA, 312 bp, Homo sapiens
atgtatggaatgatggagcaatgggacaagtacctggaagacttctccacctcgggggcctggctgcctcactatgaagacaaccaccataactgctactcttacgcactcacgttcattaactgcgttctgatggcagaaggtagacagcaactggacaagggtgaatttacggagaagtacgtggtcccgcggacaaggctggcatccaagttcatcacactctaccgggcgatacgggagcatggcttctacgtcactgactgtccccagcagcaggcacaaccccctgagggcggcggtttgtgctga

SEQ ID NO: 23401 - DNA, 849 bp, Homo sapiens
atggaaaaaaggctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataa

SEQ ID NO: 23402 - DNA, 1092 bp, Homo sapiens
atgcaaagtgacaatcaggggcgtgtgtttcagccctgtttgtggttacagctcttttagtcccgctgtgtccggaaatggtgggttcttggtctcactgacttcaagaatgaagccgcggaccctcgcggtgagtgttacagctcttaaggtgccgcgtctggagtttgttcctcctgatgttcggatgtgttccgagtttcttccttctggtggattcgtggtctcgcgggctcaggagtgaaactgcagaccttcgcggtgttacagctcataaaggcagtgtgcacccagagtgagcagcagcaggatttacggagaaggtgggcggctcaggcatggcggactgcaggtcctgagccctttcccgcgggaaggcagctaaggcccggcgagaaattgagcgcagcgccggtgggccggcactgctgggggacccagtacaccctccgcagctgctggcccgggtgcgaagcccctcattgcccggggccggcagggccggccggctgctccgagtgcggggccagccaggcccacgcccacccggaactccagctggcccggaagcgccgcgcgcagccccggttccggctcgcgcctctcccttcacacctccctgcaagctgagggagccggctccggcctcggccagcccaggaagtggctcccacagtgcagcggcaggctgaagggctcctcaagtgccgccaaagtgggagcccaggcagaggaggcgccgagagcgagcgagggctgtgaggactgccagcacgctgacacctctcaccgccatttgccaggtccagagttcttgtcctacatccaggaagaatgaagtacgtggacaactggaaagaaggacacatggtggaaatcgaagagtacaggaagaaatacaaaaaaaataaaacgagatgtgtcgttaactggaagattcaggaacgtagtaggaaaaaaatcatgaaaataaagacaattttagaaagtcattgggggaaattagcaacggtagaaaacaaagcatgtagcaggagcaaggatagaacaagtaatacaagcaaaatgaaatggaagctaaaaaggagttaa

SEQ ID NO: 23403 - DNA, 365 bp, Homo sapiens
atggcggacgacgtagaccagcaacaaactaccaacactgtagaggagcccctggatcttatcaggctcagcctagatgagcgaatttatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaa

SEQ ID NO: 23404 - DNA, 885 bp, Homo sapiens
atgaaagaccgacttcaagaactaaagcagagaacaaaggaaattgaactctctagagacagtcatgtatcaactacagaaacagaggaacaaggggtgtttctacagcaagctgttatttatgaaagagagcctgtagctgagagacacctacatgaaatccaaaaactacaggaaagtattaacaatttggcagataatgttcaaaaatttgggcagcaacagaaaagtctggtggcttcaatgagaaggtttagtctacttaagagagagtctaccattacaaaggagataaaaattcaggcagaatacatcaacagaagtttgaatgatttagttaaagaagttaaaaagtcagaggttgaaaatggtccatcttcagtggtcacaaggatacttaaatctcagcatgctgcaatgttccgccattttcagcaaatcatgtttatatacaatgacacaatagcagcaaagcaagagaagtgcaagacatttattttacgtcagcttgaagttgctggaaaagagatgtctgaagaagatgtaaatgatatgcttcatcaaggaaaatgggaagtttttaatgaaagcttacttacagaaatcaatatcactaaagcacaactttcagagattgaacagagacacaaggaacttgttaatttggagaaccaaataaaggatttaagggatcttttcattcagatatctcttttagtagaggaacaaggagagagcatcaacaatattgaaatgacagtgaatagtacaaaagagtatgttaacaatactaaagagaaatttggactagctgtaaaatacaaaaaaagaaatccttgcagagtactgtgttgttggtgctgtccatgctgtagctcaaaataa

SEQ ID NO: 23405 - DNA, 432 bp, Homo sapiens
atgagtcacgcgggaatagataacactatcgcttatttacattgggagcacccaaggcacaaaaggtttcggagtccacgcagggtcatcctatataagcaggaagagctgggacagaagccaagtcatgtcattccagactggggctttaatccccctttccaaggtgatggtgcagcagcagggccagaccttgtcatggagagcaggcagctcttcttatcagagagcttcagaaaaacaaggtcaaggcctcaaacccactctgactggcggatatttacatatgcaaagcctgccataatggctatgtttgttgagggaaaaaaggtggggaaagaaggtataaatgcttactgtttaagaaaagctggtctgtgccaatatattggagaaactattcaagaacagttgatctatgtgaaaatgtaa

SEQ ID NO: 23406 - DNA, 3273 bp, Homo sapiens
  misc_feature 285, 286, 287, 288, 289, 290, 291, 292, 293, 294, 295, 296,297, 298, 299, 300, 301, 302, 303, 304, 305, 306, 307, 308,309, 310, 311, 312, 313, 314, 315, 316, 317, 318, 319, 320,321, 322, 323, 324, 325, 326, 327, 328, 329, 330, 331: n = A,T,C or G
  misc_feature 332, 333, 334, 335, 336, 337, 338, 339, 340, 341, 342, 343,344, 345, 346, 347, 348, 349, 350, 351, 352, 353, 354, 355,356, 357, 358, 359, 360, 361, 362, 363, 364, 365, 366, 367,368, 369, 370, 371, 372, 373, 374, 375, 376, 377, 378: n = A,T,C or G
  misc_feature 379, 380, 381, 382, 383, 384: n = A,T,C or G
atggagtcgtcgctcgaggcaagcttttcgtccagcggggcagtgtcaggggcctcagggtttttgcctcctgcccgctcccgcatcttcaagataatcgtgatcggcgactccaatgtgggcaagacatgcctgacctaccgcttctgcgctggccgcttccccgaccgcaccgaggccacgataggggtggatttccgagaacgagcggtggagattgatggggagcgcatcaaggtgagcggatggggaactgttggggaggacagggtgacaggtgtcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcccagcccagccagagggaaattgcccatcccagaggtcagaacaagagtttcagcaagctttgccaccatgggctaacatgccctacagtcctaaataaacctgaaagccggtctaggccacaaggactgcatctcctagaaagttcttttttttttttttttttggagacagagtctggctctgtcacccaggctggagtgcagtggcgcaatcttggctcactgcaacctccgcctcccaggttcaagcaattctctgcctcagcctcccgagtagctgggattacaagtgcccaccaccatgcccagctaatatttgtatttttagtagagatgggatttcaccatcttggccaggctggtcttgaactcctgacctcatgatccacctgcctcggcctcccaaagtgctcggattacaggcctgagccaccgcacctggcctagaaagttctaatgctgtgctgggctcgtaactagtggacttgggggacacgtgagctagtgagacaccagcccaaacttaaaaaacatatcaatattcaggctgggcacagtggcttatgcctgtaatcccagcactttgggaggccaaggcgggcagattgcctgagctcaggagttcaagaccaacctggccaacatggtgaaacctcgtctctactaaaaatacaaaaattagccaggtgtgattgtgcacacctgtaatcccagctattcgggaggctgatacaggagaatcgcttaaacccgggagacagaggttgcagtgagccgagattgtgccactgcactccagcctgggtgacagagtgaggctctgtctcaaaaaaaaaaaaaaatcaatcaatattcaagtacaaggtggttatagaacactaagcccatttaacccaaagaagactacctcaaggcatttaataatcaaactcccaaaggtcaaaaataaaaaagggatcctaaaagcagcaagagaaaagaaacaacatacaatggaggccaggcatggtggcttacgcctgtaattgagcactttgggaggctgagaccaagtggatcgcttgaggtcaggagttcagcctggccaacgtggcaaaaccctgtctctactaaaaatacaaaaattagccgggcatggtggtgtgtgcctgtaattccagctacccaggaggctgaggcatgagaatcatttgaacatgggagacaaaggttgcagtgagccaagatcgtgccactccaccacagtctgggtgacaaagtgagactctgtctcaaagaaaagcaaacaaaaaaaccacatacaatggaactccaataggtctggcaacagacttttcagtggaaaccttataggccaggagagaatggcatgacatattttaggtgctgaaggaaaaaaacttttaccttcaaatagtatacccagcaaaaatgtccttcaaacatgaaggagaaatactttcccagacagacaaaagctgagggatttcatcaacaccagacctgtcttacaagaaatgccaaaaggagttcaatctgaaagaaaacgatgttaatgagcaataagaaatcatctgaaggtacaaaactcactggtaacagtaaatagaaaaatacagaatattgtaactgtaattgaggtgtgtaaatgactcatatcttaagtagaacaataaaaatgaatcgatcaggctgcgtgcagtggctcacgcctgtaatcccaacactttaggaggtggaggtgggtggatcacctgaggtcaggagttccagaccagcctggccaacatggtgaaacccgtctctactaaaaatacaaaaaattagccaggtgtggtggcaggcacctgtaatcccagctacttgggaggctgaggcaggagaactgcttcaacccaggaggcggaggttgcagtgagctgacatcacgccctgcactccagcctgggcgacagagtgagacttcgcctcagaaaaaaataaaaaattaaattaaaaaagcctgggacctgatggcttcactgccaaattttaccaaacatttaaagaagagctattaccaatcctgctcaaactattccaaaaaatagaggaggagggaatacttccaaactcattctatgaggcaaaatcagacaaagatgaatcaaaagaagaaaactacaggccaatatccctgatgaacattgatgcaaaagtcttcaataaaatactagcaaaccatattcagcaacgcattaaaaaaatcattcatcacgatcaagtgggatttatccctgggatgcaagggggtttcaacaaatgcaaatcagtcagtgtgataatgtgataacatatcaacagaatgaagaacaaaaaccatatggtcatttcaattgatgctgaaaaatctttttataaaattcaacatcccttcatgataaaaaccctcaaataactgggtatagatggaacataacataataaatgccatatatgacagacccatagctagtgtcatattgaatggggaaaaactgaaaaccttctaagatctggaacacaacatggatgcccactgtgaccactgttattcaacacagtactgtatatcctagatagagcaatcacacaagagaaagaaaaggcttccaaattggaaaggaagaagtcaaattattgttgtttgctgatgatatgattttacatttggaaaaacctaaagattccacaagaagagtattaggactgataaacaaattctgtaaagttgcaggatacaaataaacatacaaaaataagtagcaccctttccacagcttcccattctttagaaaccaggctgcatattcccggtggtggcacgctggattccaggctctcgcatccccaccagcctccctga

SEQ ID NO: 23407 - DNA, 3896 bp, Homo sapiens
atggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctgttggtaggaggacagtttgatctggaaatgaatttcattatccaagaaggtgagagtattaactgcatggtggacctactggaaaaatgtgacattacgtgccaagcagaagtctggagcatgtttacagccattctgaagaaaagcatacggaatcttcaagtctgcactgaagtaggccttgttgaaaaagtgcttgggaaaattgaaaaagttgacaatatgatagcagatcttttggttgacatgttgggagtgctggctagctataatttgacagttcgcgagctaaagcttttcttcagtaaacttcaaggagataaaggacgatggcctccacatgctgggaagttgctgtctgtgttaaagcatatgcctcagaagtatggtcctgatgccttttttaactttccaggaaagagtgctgcagctattgcattacctcctatagccaaatggccataccagaatggttttacatttcatacatggcttagaatggatcctgtaaataacatcaatgtagataaggataaaccatatttgtattgtttcagaaccagcaaaggtcttggctattctgctcattttgttggaggctgtttgattgtaacatcaataaagtcaaaaggaaaaggctttcaacactgtgtgaaatttgatttcaagccacaaaagtggtatatggttaccatagtacacatctataaccgatggaagaatagtgaacttcgatgttatgtgaatggtgagctggcttcctatggagagataacatggtttgtcaacactagcgatacctttgacaaatgtttcctgggctcatcagaaacagcagatgctaatagagtattctgtgttgggcctgggatacaagggtacatttaaattcaaagcagaaagcgaccttttccttgctgagcatcacaaacttttattgtacgatgggaaactctctagtgccattgcattcacgtacaatccacgggctacagatgcccagctttgtcttgaatcatctcctaaggacaacccttcaatttttgttcattcaccacatgcgctcatgctccaggatgtaaaggcagttttaacacattccatccaaagtgcaatgcattcaattggaggagtacaagtactatttccactttttgcacagttggattacaggcaatatttgtctgatgagattgatttgactatatgttcaaccttgctggcctttatcatggaatttacttgaactttgccttgcattttcaaaatatctgagtaatctgcagaatgggatgcccctgctcaagcaattgtgtgatcacgttcttcttaatcctgccatatggattcataccccagccaaggttcaactgatgctctatacttatctgtccacggaattcattggtacagtcaacatatataacaccattcggagagttggaacagtgcttctcatcatgcacacgctgaagtactactactgggcagtgaatcctcaggatcgaagtggtatcaccccaaaaggattagatggaccgcgacctaatcaaaaagaaatgctttctctacgagcattcttgttgatgttcattaagcaattagtgatgaaggattctggagtaaaggaagatgaattacaggccattcttaattacctactgactatgcatgaggatgacaatctaatggatgtcctacagctgcttgttgcattaatgtcagaacaccctaactctatgattcctgcttttgaccaaaggaatgggttacgtgttatctacaaacttctggcatcgaaaagtgaaggaatcagggtacaagctcttaaggcaatgggttattttttaaaacatctggccccaaagaggaaagcagaagtcatgcttggacatggattgttttcattgctagctgaaaggctcatgcttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatggctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaaggtttgtctatatgtttattatggaagatgtgtataaacctagtctttattttcaaagaaatccatag

SEQ ID NO: 23408 - DNA, 1648 bp, Homo sapiens
atgtccaacaaagtgatactgacattaagtgccatagccacacttgatcgtattggcacagatggtgactgcagtaaacctgaagaaaagaagactggtgaggtagccacggggatggcctctagacccaactggctgctggcaggggctgcttttggtagccttgtgttcctcacccactgggtttttggagaagtctctcttgtttccagatgggcagtgagtgggcatccacatccagggccagatcctaacccatttgggtgcagtactgctgtgcttggcaagtggattgatgcttccatcttgtttgtggtttcgtggtactggtttgatctggtgggttacaggaacagcttcagctgcggggctcctttacctgcacacatgggcagctgctgtgtctggctgtgtcttcgccatctttactgcatccatgtggccccaaacacttggacaccttattaactcagggacaaaccctgggaaaaccatgaccattgccatgatattttatcttctagaaatatttttctgtgcctggtgcacagcttttaagtttgtcccaggaggtgtctacgctagagaaagatcagatgtgcttttggggacaatgatgttaattatcgggctgaatatgctatttggtcctaagaaaaaccttgacttgcttcttcaaacaaaaaacagttctaaagtgcttttcagaaagagtgaaaaatacatgaaactttttctgtggctgcttgttggtgtgggattgttgggattaggactacggcataaagcctatgagagaaaactgggcaaagtggcaccaaccaaagaggtctctgctgccatctggcctttcaggtttggatatgacaatgaagggtggtctagtctagaaagatcagctcacctgctcaatgaaacaggtgcagatttcataacaattttggagagtgatgcttctaagccctatatggggaacaatgacttaaccatgtggctaggggaaaagttgggtttctatacagactttggtccaagcacaaggtatcacacttgggggattatggctttgtcaagatacccaattgtgaaatctgagcatcaccttcttccgtcaccagagggcgagatcgcaccagccatcacattgaccgttaacatttcgggcaagctggtggattttgtcgtgacacactttgggaaccacgaagatgacctcgacaggaaactgcaggctattgctgtttcaaaactactgaaaagtagctctaatcaagtgatatttctgggatatatcacttcagcacctggctccagagattatctacagctcactgaacatggcaatgtgaaggatatcgacagcactgatcatgacagatggtgtgaatacattatgtatcgagggctgatcaggttgggttatgcaagaatctcccatgctgaactgagtgattcagaaattcagatggcaaaatttaggatccctgatgaccccactaattatagagacaaccagaaagtggtcatagaccacagagaagtttctgagaaaattcattttaatcccagatttggatcctacaaagaaggacacaattatgaaaacaaccatcattttcatatgaatactcccaaatactttttatga

SEQ ID NO: 23409 - DNA, 276 bp, Homo sapiens
atggagggcagcaaaggcagtaccactgcagtggcagtctcagagggcatttcatttgcctctgggagctccaccccagagcaacacagagccactgacaatgggtatgttcagccacgaggacacatcccaaatccatttgagagcctgaaagttcctataggaggccagctctatccatattctattgaagtcagcaggagctctttagaagtgccagataaaaagctgatctgtggacatcctgattcagcagtggtgacaccagcattgtaa

SEQ ID NO: 23410 - DNA, 756 bp, Homo sapiens
atggttctgaatcaaggtgagcattgtaagagtgatgacgaagatgatgtttacactggagaaaaagcacctatagatgacatggtgaaagtatgtaatgggcttattgaaggactggagcattgtgcattcgtaacagaccaaggagtcaacctgcaaaactgctgtagaatatcaagcagttgttctagtgaagtcaattattttttagctcactgcaaaacatctgttgacccacgttttagtcttctgttcactctcttccaagtgtcgagcatgcgcactttggtcgtgggcgcgtgtgtggaatgggaggaggtcgcgctgtccatgggcgtccttggcctgcgccacccaatgataaatagccaaagacgtcaatggcacccatggacagtcctcatgagggagcctcagagagtggagaaagtccaggttcatcacgatagcacctcggctgtgaactcacatgaacagatctgtgatcttgccaagtctaatctgaccaaattattgacagctttgcatcgtacacaagtgactggggacctctcctctgaatccagagatgaagaaactgttctgggagagaggaaaggaggccacggaacagcaaacccaatcactccccggggccagcagaggcccttcaggttcaagctagtctgccagcacacgactaaaggttctcagcttggcctgtccatggcccactgtctgctgcttctggatcctatttctaccataggcttttaa

SEQ ID NO: 23411 - DNA, 462 bp, Homo sapiens
atgaatggggatatgccccatgtccccattactactcttgcggggattgctagtctcacagacctcctgaaccagctgcctcttccatctcctttacctgctacaactacaaagagccttctctttaatgcacgaatagcagaagaggtgaactgccttttggcttgtagggatgacaatttggtttcacagcttgtccatagcctcaaccaggtatcaacagatcacatagagttgaaagataaccttggcagtgatgacccagaaggtgacataccagtcttgttgcaggccgtcctggcaaggagtcctaatgttttcagggagaaaagcatgcagaacagatatgtacaaagtggaatgatgatgtctcagtataaactttctcagaattccatgcacagtagtcctgcatcttccaattatcaacaaaccactatctcacatagcccctccaggtaa

SEQ ID NO: 23412 - DNA, 2448 bp, Homo sapiens
atgccatttgaagactgcacaaatgatcctgagtcagaacatgacctgttgcttaatggctgtttgaaatcactggcttttgattctgaacattctgcagatgagaaggaaaagccttgcgctaaatctcgagccagaaagagctctgataatccaaaaaggactagtgtgaaaaagggccacatacaatttgaagcacataaagatgaacggaggggaaagattccagagaaccttggcctaaactttatctctggggatatatctgatacgcaggcctctaatgaactttccaggatagcaaatagcctcacagggtccaacactgccccaggaagttttctgttttcttcctgtggaaaaaacactgcaaagaaagaatttgagacttcaaatggtgactctttattgggcttgcctgagggtgctttgatctcaaagtgttctcgagagaagaataaaccccaacgaagcctggtgtgtggttcaaaagtgaagctctgctatattggagcaggtgatgaggaaaagcgaagtgattccattagtatctgtaccacttctgatgatggaagcagtgacctggatcccatagaacacagctcagagtctgataacagtgtccttgaaattccagatgctttcgatagaacagagaacatgttatctatgcagaaaaatgaaaagataaagtattctaggtttgctgccacaaacactagggtaaaagcaaaacagaagcctctcattagtaactcacatacagaccacttaatgggttgtactaagagtgcagagcctggaaccgagacgtctcaggttaatctctctgatctgaaggcatctactcttgttcacaaaccccagtcagattttacaaatgatgctctctctccaaaattcaacctgtcatcaagcatatccagtgagaactcgttaataaagggtggggcagcaaatcaagctctattacattcgaaaagcaaacagcccaagttccgaagtataaagtgcaaacacaaagaaaatccagttatggcagaacccccagttataaatgaggagtgcagtttgaaatgctgctcttctgataccaaaggctctcctttggccagcatttctaaaagtgggaaagtggatggtctaaaactactgaacaatatgcatgagaaaaccagggattcaagtgacatagaaacagcagtggtgaaacatgttttatccgagttgaaggaactctcttacagatccttaggtgaggatgtcagtgactctggaacatcaaagccatcaaaaccattacttttctcttctgcttctagtcagaatcacatacctattgaaccagactacaaattcagtacattgctaatgatgttgaaagatatgcatgatagtaagacgaaggagcagcggttgatgactgctcaaaacctggtctcttaccggagtcctggtcgtggggactgttctactaatagtcctgtaggagtctctaaggttttggtttcaggaggctccacacacaattcagagaaaaagggagatggcactcagaactccgccaatcctagccctagtgggggtgactctgcattatctggcgagttgtctgcttccctacctggcttactgtccgacaagagagacctccctgcttctggtaaaagtcgttcagactgtgttactaggcgcaactgtggacgatcaaagccttcatccaaattgcgagatgctttttcagcccaaatggtaaagaacacagtgaaccgtaaagccttaaagaccgagcgcaaaagaaaactgaatcagcttccaagtgtgactcttgatgctgtactgcagggagaccgagaacgtggaggttcattgagaggtggggcagaagatcctagtaaagaggatccccttcagataatgggccacttaacaagtgaagatggtgaccatttttctgatgtgcatttcgatagcaaggttaagcaatctgatcctggtaaaatttctgaaaaaggactctcttttgaaaacggaaaaggcccagagctggactctgtaatgaacagtgagaatgatgaactcaatggtgtaaatcaagtggtgcctaaaaagcggtggcagcgtttaaaccaaaggcgcactaaacctcgtaagcgcatgaacagatttaaagagaaagaaaactctgagtgtgcctttagggtcttacttcctagtgaccctgtgcaggaggggcgggatgagtttccagagcatagaactccttcagcaagcatacttgaggaaccactgacagagcaaaatcatgctgactgcttagattcagctgggccacggttaaatgtttgtgataaatccagtgccagcattggtgacatggaaaaggagccaggaattcccagtttgacaccacaggctgagctccctgaaccaggtaaggacatctaa

SEQ ID NO: 23413 - DNA, 588 bp, Homo sapiens
atgaaaagagaagagaatagtcaaatcgacccccttgtgcagaagcgcaggctactagactccatgctaaattgggggaagcatttagaaggtatcaccctgcacttcattaagtggagcaatcgcaggtttaggacagaaaacaaaatagagcactacgaacctgtaacaaacatccacaaactagaccatgaaaaccagagtgtaaataagcttcccctacattttttgggtcttcctatattttggagactccaggtaattttatttagcctcagaagtgacagtgcaaagctgggcatggtggctcacgcctgtaatcccagcactttgggaggccgaggtgggtggatcacctgaggtcaggagttcaagaccagcctggccaacatggtgaaaccccatctctactaaaaatacaaaaattcgccaggcgtggtggcaagcacctgtaatcccagctacttgggaggctgaggcaggagaatggcttgaacccaggaggcggaggttgcagtgagccgagattgagccattgcactccagcctgggcgacaagagcaaaactccgtctcaaaaagtaactaa

SEQ ID NO: 23414 - DNA, 502 bp, Homo sapiens
atgaccaggtgggcccgagttagtaccacatataacaagagacccttgcctgcaacatcatgggaggacatgaagaagggatcctttgagggaacaagccaaaacctaccaaagcgtaaacaacttgaagccaataggctatccctcaaaaatgatgcaccccaagcaaaacataaaaagaacaaaaagaaaaaagagtacttaaatgaagatgtgaatggattcatggaatacctaagacagaattcacagatggttcacaatgggcaaattatagcaacagacagtgaggaagtaagggaagaaattgcagttgctttaaagaaagacagtcgacgggaaggaagaagattaaaaagacaagcggcaaagaaaaatgcaatggtgtgtttccattgtagaaaacctggtcatggaattgcagattgccccgccgcccttgaaaatcaagacatgggcactgggatatgttacaggtgtgggtccacagagcacgaaataa

SEQ ID NO: 23415 - DNA, 477 bp, Homo sapiens
atgagttctgcaccgaatgggcgcaaaaagcgccccagccggtccacccgctcctcgatcttccagatcagcaagcccccgctgcagagcggagattgggagcgcaggggcagcggctccgagagcgcccacaaaacccaacgagccctggacgactgcaagatgcttgtccaagagttcaacacacaagtggccctgtaccgagagctggtcatttctattggggatgtctcggtcagctgcccctcactccgggcggaaatgcacaagacaagaaccaaaggctgtgaaatggcccgtcaggcacaccaaaaattggctgccatctcaggcccggaagatggtgagatccatccagaaatctgtcggctttacatccagctgcagtgctgcttagaaatgtataccacagagatgctaaaatccatatgtctgctggggtctcttcagtttcatcgaaaaggtatctacatttaa

SEQ ID NO: 23416 - DNA, 720 bp, Homo sapiens
atggaacatggacctaaagcagtgactattgcaaattctccatcaaagccttcagaaaaggattctgtagtttcccttgagtcccagaagacacctgctgacccaaaactgaaaactctaagtcaaaccaaaaaaaacaaaggatctgatagctcactctctggtaacagtgatggcggagaagaattttgtgaagaggagaaggaatattttgatgatagcacagaagaaaggttttacaagcagtcttccatgtctgaagatagtgatagcggtgacgacttcttcattgggaaagtcagacggacacgaaagaaggaaagtagttgtcattcttcagttaaggaacaaaaaccactagaaaaagtgtttcttaaagaagatacaggtgaaactcatggggatacaagaaatgacaaaatcaagccaagtacagaaaccagaaagttagaatcagtgtttttccactctttatctggatctaaaagctctagaagaaatttcaaagaacaggctccaaaaacaagatccctagattttccacagaatgagcctcagatcaagaatcagtttaataagaagctatcaggaagacttgaaaatacaaaacagcaattgcagctgcctcttcatccttcatgggaagcaagcagaaggcgaaaagaacagcaatctaatattgctgtgtttcaggggaaaaaaattacgtttgatgattga

SEQ ID NO: 23417 - DNA, 990 bp, Homo sapiens
atgtcggagatcctgtgccagtggctcaacaaggagttgaaggtgtcccggaccgtgcccaagtcatttgcaaaggcattttccagtggctatctacttggagaagttctacacaagtttgaacttcaggatgatttttcagaatttttggacagcgtttcaagtgccaaacttaataatttttctcgcttggagccaacacttaaccttctgggtgtgcagtttgatcagaatgtggcccatggcatcatcacagaaaagcctggggtggcaacaaagctgttatatcaattgtacattgctcttcagaaaaagaagaaaagtggactgactggagtggagatgcaaaccatgcaacgtctgacaaatttaagacttcaaaacatgaaaagtgatacttttcaagagcaatacttaaacagaagacgacaaaatgaaataatggccaaaatccaagcagctattatacagattcctaaacctgcatcaaatcgtactttgaaagcactcgaggcccaaaaaatgatgaaaaagaaaaaagaggcagaagatgtggctgatgaaattaagaagttcgaagcattaataaaaaaggatctccaagcaaaagaagcatccaagacttctttagatacagcaggccagacaaccaccgatttgttaaatacttactcagatgacgagtacattaaaaaaatccagaagcgccttgaagaagatgcttttgcacgagagcaaagggagaaaagacggcggaaattgttaatggaccagttaatagcccacgaagcacaagaggaggcttatcgggaggaacagctgattaaccggctgatgcggcagtcccagcaggagcgcaggattgccgtgcagctcatgcatgttcggcatgaaaaggaagttttatggcaaaacagaattttcagagaaaaacaacatgaggaaagacgacttaaagatttccaggatgctcttgatcgagaagcgtga

SEQ ID NO: 23418 - DNA, 405 bp, Homo sapiens
atgtctgggttcccaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgctggattggcctgtaagaaccctcagtttcagccatga

SEQ ID NO: 23419 - DNA, 279 bp, Homo sapiens
ggctcagctcagctgctgatgttagacagccttgtgccacaagaagtgtgtcagagcccagaggagccactgccccccacccagtcagggactggagttgaattctaccatactggagagaatctagccctgcccaagtgcccagcttcttccaactcctactccttggaagcaaccaagtggtatgagttggcccctactcaccccctccctggtgtcagtggaccatatcagggaagtgaggttattttttcacttggaggaaacaaagatatgtaa

SEQ ID NO: 23420 - DNA, 1614 bp, Homo sapiens
atggttgtgagctccctcgtcattggagccctccttgcctcactcaccggaggggtcctgatagacagatatggaagaaggacagcaatcatcttgtcatcctgcctgcttggactcggaagcttagtcttgatcctcagtttatcctacacggttcttatagtgggacgcattgccataggggtctccatctccctctcttccattgccacttgtgtttacatcgcagagattgctcctcaacacagaagaggccttcttgtgtcactgaatgagctgatgattgtcatcggcattctttctgcctatatttcaaattacgcatttgccaatgttttccatggctggaagtacatgtttggtcttgtgattcccttgggagttttgcaagcaattgcaatgtattttcttcctccaagccctcggtttctggtgatgaaaggacaagagggagctgctagcaaggttcttggaaggttaagagcactctcagatacaactgaggaactcactgtgatcaaatcctccctgaaagatgaatatcagtacagtttttgggatctgtttcgttcaaaagacaacatgcggacccgaataatgataggactaacactagtattttttgtacaaatcactggccaaccaaacatattgttctatgcatcaactgttttgaagtcagttggatttcaaagcaatgaggcagctagcctcgcctccactggggttggagtcgtcaaggtcattagcaccatccctgccactcttcttgtagaccatgtcggcagcaaaacattcctctgcattggctcctctgtgatggcagcttcgttggtgaccatgggcatcgtaaatctcaacatccacatgaacttcacccatatctgcagaagccacaattctatcaaccagtccttggatgagtctgtgatttatggaccaggaaacctgtcaaccaacaacaatactctcagagaccacttcaaagggatttcttcccatagcagaagctcactcatgcccctgagaaatgatgtggataagagaggggagacgacctcagcatccttgctaaatgctggattaagccacactgaataccagatagtcacagaccctggggacgtcccagcttttttgaaatggctgtccttagccagcttgcttgtttatgttgctgctttttcaattggtctaggaccaatgccctggctggtgctcagcgagatctttcctggtgggatcagaggacgagccatggctttaacttctagcatgaactggggcatcaatctcctcatctcgctgacatttttgactgtaactgatcttattggcctgccatgggtgtgctttatatatacaatcatgagtctagcatccctgctttttgttgttatgtttatacctgagacaaagggatgctctttggaacaaatatcaatggagctagcaaaagtgaactatgtgaaaaacaacatttgttttatgagtcatcaccaagaagaattagtgccaaaacagcctcaaaaaagaaaaccccaggagcagctcttggagtgtaacaagctgtgtggtaggggccaatccaggcagctttctccagagacctaa

SEQ ID NO: 23421 - DNA, 2214 bp, Homo sapiens
atggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccagttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaactatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattag

SEQ ID NO: 23422 - DNA, 264 bp, Homo sapiens
gcctgcttgaatttcttgaaactgtgcaaaataaaatattacaattattgccttattcacaatgtacagagggattttatcatacaaactggcgatcctacagggactggccgtggaggagagtctatctttggccaactgtatggtgatcaagcaagcttttttgaggcagaaaaagtcccaagaattaagcacaagaagaaaggcacagtgtccatggtgaataatggcagtgatcaacatggatctcaggttaggaaatga

SEQ ID NO: 23423 - DNA, 389 bp, Homo sapiens
gtatctttttaaaaaaattctatgctttgcacaactggtttctgaaaatggattttatggaaactaaagaaaagtgcttttatggaaaaaaacaaaaggccagcatacagagaattaagaagccagtccatgagctgaaccaacttcaaattggccttggtggaattacgtacaccacggaaatcagcaaacactataacgcagtactatttttatctccccaaaatatagctaaccagcacaccatggaatcttatgtagttattagacgaacacaggacctgaaccttgccttaactaaaaccacaatttacttcccaagtctatattattggaaaacaagggaaatgggtgggagctggggagaacatggtaaatttaaagattag

SEQ ID NO: 23424 - DNA, 1179 bp, Homo sapiens
atgatatctggcttcttttgctctgaggctcatccgctgctgtgtggctcgttgctgtgcagtggcactcggtgtgaatacaccacgctttatgtgctggactgtggaaagggattcggttgggctggggagtcagccaagtggatggcaaatacaagctgtgtgctcaaggccgtgggacgtggagggccctggatctgtctcaacctcgtcgcttgtggtcccacctcatatccgtctatcactaccttctccaaggagtactacgagatgagtgacaacatgggtggctgctacaaagacacagaactggaaagtcacaaacgtggccctgaacctggaggaggaggggctcggcgcttcttcatctccgacttcacggacacccctgagatgctgcccagcgagagggatggacccagcgtaagagaacgacaggaactggcgtctgtggtgctttccccacctgtggtcaaagacagaacctggatcaagacacacgaagagctggccaggagcttggaggagggcagcgggggcggcgttgcaggctctctgcagcccccggccgcgcgcacctggcggaccgggctgcgctctggatgccgcgtgaaaccgcagggcgcaaagcagggaggtggggaggaggctttggagaccacaggtgctgggaagtggagccgccaggaggcctgggccagccctggaggtgtcctcatcgctgtctgcacccgacagcacgagctgctcagcctggaacacaagcaccaggccacatcatctccaggccgacatatctggtctaagtcggcagcattcagagtgctcctcacaacagcacccagcgttttctctcagacccagctcttggtaccagcaacatattgggtccccagctccagaggatcccggggtgcaaaggctacaaaatgccatacactggatgccataactcatctgccgcagttcaggagtgtacagtcaatcaccaatcagcgttatttctgtaaactagttgacaatggtgaaaaacagccccttgcaatccacagagaggactcgatcactgactgcgccttcactgctgtgtcgacaatggtgaaaaacagaaagtcccttgcaatccacgaacgggactggatcactgactgcgccttcactgctgtatcgaaatggtga

SEQ ID NO: 23425 - DNA, 263 bp, Homo sapiens
gtcaaccctcatcctcacagagggagcaagatggccaaggtttccaggaattgacggtcacttctgaaatgttcaggaaaggaaaaggaagtttctgctcccatcctcaccctgagaagttcctcagagcaggtggcagaggactgcgtctagaagagtcattagaagagaaacagaatttgttaggttggcaaaggagtagtgtggctagaaaagccattccaagtggagaaattcatggatacagactcacagaggcgtga

SEQ ID NO: 23426 - DNA, 747 bp, Homo sapiens
atgggttatcctcgtttaggtggagaaggtggaaaaggtggtgatgtctgggttgtagcccagaacagaatgactttaaaacaacttaaagacaggtatcctcggaaacggtttgtggctggagtaggagcaaacagcaaaattagtgcactgaaaggctccaaaggaaaagactgtgaaatccctgtgcctgtgggtatttcagtaactgatgaaaatggtaaaattataggagaactcaataaagaaaatgacagaattttggtagctcaaggaggtcttggtggtaaattacttacaaatttcttaccattgaaaggccagaaacgaataattcaccttgatctaaaacttatagctgatgtaggcctagtaggattcccaaatgctggaaaatcctctttgctaagttgtgtttctcatgcaaaacctgcaattgcagattacgcatttacaacattaaagcctgaacttggaaagataatgtacagtgatttcaaacagatatcagtagctgatcttccgggtttaatagaaggagcacatatgaacaaaggaatgggccacaaattcctcaagcatatagaaagaactagacaactactttttgttgttgatatttctggatttcagctttcttctcacactcaatacaggacagcttttgaaaccataatactgcttacaaaagtagttggaattgtacaaagaggaacttcagacaaaacctgcactcttggcagttaa

SEQ ID NO: 23427 - DNA, 477 bp, Homo sapiens
atggctggtaagcaggccgtttcagcatcaggcaagtggctggatggtattcgaaaatggtattacaatgctgcaggattcaataaactggggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggtctttgctgttccagctctgcactctgcttcctacttagatgaaaagatcagcccattgagtgtccctccagatcccaagaagagcttctgtgaagcaaactctcaccccttgaactgcattgaaactaggcaaaggcctgaaaatttctaccttgaaccgtatctgaaagaggttattcgggaaagaaaagaaagagaagaatgggcaaagaagtaa

SEQ ID NO: 23428 - DNA, 384 bp, Homo sapiens
atggctacacacaacgttatcgttcttcctggctcgaaatttccgaagtttcctcgatcgggaatagggaagggagagagatattgttttcagcagagaaccactcttagaatttttaatgtattggatttaataccaaatgcatgtggggtttttgtggaagtatatctcaccccaagacctttggactacagtgagcagacttgtgggacagaatacactcttgaagatgttgatgtaaacgaagtttgtatctttgatggacttgtggatgaaagcattcagaagaaggtgacatttcaaaaggcccaggaatactctttcaggacagcccacttgtctgtcattccagggatacatgaccagacaccagagtggaaataa

SEQ ID NO: 23429 - DNA, 975 bp, Homo sapiens
atgacagacgcaggccaaccacattccgaagcagattatacactggggccactgctctgccgcggagataagtcattttggaattcagcttccttcaacactgagacttcataccttcatttccctgctttccacggagaactcactgctgacgtgtgcttcttttttaagaccacagtttcctctggggtgtttatggagaacctggggatcacagacttcatcaggattgagctgcgggctcccacagaagtgaccttttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtggaacggccaccagacagagaggctttctaggatgcattcggtctctgcagttgaacggggtggccctggatcttgaagaaagagccacagtgatgccaggagtggagccagggtgtgcaggacactgcagcacctatggacacttgtgtcgcaatggagggagatgcagagagaaacgcaggggggtcacctgtgactgtgccttctcagcctatgatggaccgttctgctccaatgagatttccgcatattttgcaactggctcctcaatgacataccattttcaagaacattacactttaagtgaaaactccagctctctcgtttcttcattatacagagatgtaacattgaccagagaaatgatcacactgagcttccgaaccacacgatctccgagcttattgctgtatgtgagctctttctatgaggaatacctttcagttatcctcgccaacaatggtgaatatcttttgtgtaaagaaaaagagaaccctgagttagaaaaatag

SEQ ID NO: 23430 - DNA, 909 bp, Homo sapiens
atgtctgaagatgaagaaaaagtgaaattacgccgtcttgaaccagctatccagaaattcattaagatagtaatcccaacagacctggaaaggttaagaaagcaccagataaatattgagaagtatcaaaggtgcagaatctgggacaagttgcatgaagagcatatcaatgcaggacgtacagttcagcaactccgatccaatatccgagaaattgagaaactttgtttgaaagtccgaaaggatgacctagtacttctgaagagaatgatagatcctgttaaagaagaagcatcagcagcaacagcagaatttctccaactccatttggaatctgtagaagaacttaagaagcaatttaatgatgaagaaactttgctacagcctcctttgaccagatccatgactgttggtggagcatttcatactactgaagctgaagctagttctcagagtttgactcagatatatgccttacctgaaattcctcaagatcaaaatgctgcagaatcgtgggaaaccttagaagcggacttaattgaacttagccaactggtcactgacttctctctcctagtgaattctcagcaggagaagattgacagcattgcagaccatgtcaacagtgctgctgtgaatgttgaagagggaaccaaaaacttagggaaggctgcaaaatacaagctggcagctctgcctgtggcaggtgcactcatcgggggaatggtagggggtcctattggcctccttgcaggcttcaaagtggcaggaattgcagctgcacttggtggtggggtgttgggcttcacaggtggaaaattgatacaaagaaagaaacagaaaatgatggagaagctcacttccagctgtccagatcttcccagccaaactgacaagaaatgcagttaa

SEQ ID NO: 23431 - DNA, 8553 bp, Homo sapiens
atgaaccacttggaggggtctgcggaggtggaggtgaccgacgaggcggcaggtggggaggtgaacgagtcggtggaggccgacctggagcaccccgaggtggaagaggaacagcagcagccgccgcagcagcagcactatgtgggccgccaccagcgcgggcgagccctcgaggacctccgcgcccagctcggccaggaggaagaggagcgcggggaatgcctggcgcgctcagccagcacggagagcggcttccacaaccacacggacaccgccgagggcgacgtgatcgccgcggcccgcgacggctacgatgcggagcgcgcgcaggaccccgaggacgagagcgcctatgctgtgcagtaccggcccgaggccgaggagtacacggagcaggcagaggccgagcacgccgaggccacgccccgccgcgcgctgcccaaccacctgcaattccactcgctggagcccgaggaagccatgaatgcggcctactcaggctacgtctacacgcaccggctcttccaccgcggtgaggacgagccctactccgagccctatgccgactacggcggcctccaggagcacgtgtacgaggagataggggacgcgcccgagctggacgcacgcgacggcctgcggctctacgagcaggagcgcgacgaggcggccgcgtaccgccaggaggccctgggcgcgcggctgcaccattacgacgagcgctccgacggcgagtccgacagccccgagaaggaggccgagttcgcgccctacccgcgcatggacagctacgagcaggaggaggacatcgaccagatagtggccgaggtgaagcagagcatgagctcgcagagcctcgacaaggcagccgaggacatgcctgaggccgagcaggacctggagcgtccccctaccccggccgggggtcgccccgacagccccgggctgcaggcgccggcggggcagcagcgggcggtgggccccgcgggcggcggcgaggcggagcagcggtacagcaaggagaagcgcgatgccatctcgctggccatcaaggacatcaaggaggccatcgaggaggtgaaaaccaggaccatccgttcgccttacacccccgacgagcccaaagagcccatctgggtcatgcgccaggacattagccccaccagggactgtgacgaccagaggccgatcgacggagattctccgtctcctggcagctcctcccccttgggtgcagagtcatcaagcacatctcttcaccccagtgaccctgtggaagcgtccactaataaagagtcaagaaaaagcttggcttcattcccaacctacgttgaagttccgggaccctgcgaccccgaagacttgatcgatggaatcatttttgccgccaattaccttggctccactcagctgctctcagacaaaactccttccaaaaacgtgcgcatgatgcaggcccaggaagccgtaagcaggatcaagatggcccagaaattagccaaaagcaggaagaaggctcctgaaggcgaatctcagccaatgactgaagtggatctcttcatttctacccagagaatcaaagtgctgaacgccgacacacaggagacaatgatggaccaccctctgaggaccatttcctacattgcggacattgggaacatcgttgtgctgatggcccgccggcggatgcctcgctccaactcccaggagaacgtggaagcgtcccacccatcccaggatgggaaaaggcagtacaagatgatctgccacgtcttcgagtctgaggatgctcagctgattgcacagtccatcggacaggcatttagcgtggcataccaggaattcctcagggccaatgggattaaccccgaagatctcagccagaaggagtatagtgacctgctcaatacccaggacatgtacaacgatgacctgatccacttctccaagtcggaaaactgtaaagatgttttcatagagaagcagaaaggagaaatcctaggtgtggtgattgtggagtctggctggggatccatcctccccaccgtgatcattgccaacatgatgcatggtggccctgcggagaaatctgggaagctgaatatcggtgaccagatcatgtccattaatggcaccagcctggtgggcctgcctctgtccacctgccagagcattattaagggcttaaagaatcagtcccgagtcaagctgaatatcgtgagatgtcctccggtgaccaccgtgttaatcagaagaccagaccttcgctaccagctcggtttcagcgtccagaatggaattgtaagtagaacaccttccacacccttttccacaatgttgacaaataaaaatgtagcatggctgggggggtggagccaagatggctaaataggaacagctccagtctacaactcccagcgtgagtgatgcagaagacgggtaatttctgcatttccaactgaggtaccaggttcatctcactggggagtgccggtcagtgggtgcaggacagtgggtgcagcgcactgtgcaagagctgaagcaggacaaggcatcgcctcacccgggaagcgcaaggggtcagggaattccctttcctagtcaaagaaaggggtgacagacagcacctggaaaatcgggtcactcccaccctaatactgcacttttccaatgggcataacaaacggcacaccaggagattataccccacacctggctcggagggtcctacgcccatggagcctcactcattgctagcacagcagtctgagatcaaactgcaaggtggcagcgaggctgggggaggggcacccaccattgcccaggcttgagtaggtaaacaaagcagcggggaagctcgaacggggtggagcccactacagctcaaggaggcctgcctgcctctgtaggctccacctctgggggcagggcacagacaaacaaaaggcagcagtaacctctacagacttaaatgtccctgtctgacagctttgaagagagtagtggttctcccagcacacagcttgagatctgagaatgggcagactgcctcctgaagtgtgtccctgacccctgagtagcctaactgggaggcaccccccagtaggagcagactgacacctcacacagccgggtactcctctgagacaaaacttccagaggaacgatcaggcagcagcatttgcggttcaccaatatccgctgttctgcagccactgctgctgatacccaggcaaacagggtctggagtggacctccagtaaactccaacagacctgcagctgagggtcctgactgttagaaggaaaactaacaaacagaaaggacatccaaaccaaaaacccatctgtacgtcagcatcatcaaagaccaaaggtagataaaaccacaaagatggggaaaaaacagagcagaaaaaccagaaactctacaaaccagagcacctctcctcctgcaaaggaacacagctccttaccagcaacggaacaaagctggatggagaatgactttgacgagttgagagaagaaggcttcagaagatcaaactactctgagctaaaggaggaagttcaaaccaatggcaaagaagtgaaaaactttgaaaaaaaattagacgaatggataactagaataaccaatgcagagaagtccttaaaggacctgatggagctgaaaaccacactacaagaatgtgacaaatgcacaagcctcagtaaccgatgtgatcaactggaagaaagggtatcagcaatggaagatgaaatgaatgaaatgaagcataaagaggattttagagaaaaaagaataaaaagatagatagataggaacaaagcctccaagaaatatgggactatgtgaaaagaccaaatctacgtctgattggtgtacctgaaagtgacggggagaatggaaccaagttggaaaacactctgcaggatattatccaggagaatttccccaatctagcaaggcagaccaacattcaaattcaggaaatacagagaacgccacaaagatactcctcgagaagagaactccaagacacataattgtcagattcaccaaagttgaaatgaaggaaaaaacgttaagggcagccagagagaaaggtcaggttacccacaaagggaagcccatcagactaacagcggatctcttggcagaaactctacaagccagaagagagtggggccaatattcaacattcttaaagaaaagaattttcaagccagaatttcatatccagccaaactaaacttcataagtgaaggagaaataaagtacattacagacaagcaaatgctgagagatttttgtcaccaccagacctgctgtaaaacagctcctgaaggaagcactaaacatggaaaggaataaccagtaacagccactgcaaaaacatgccaaattgtaaagaccatcgaggctaggaaaaaactgcatcaactaacgagcaaaataaccagctaacatcataatgacaggatcaaattcacacataacaatactaaccttaaatgtaaatgggctaaatgctccaattaaaaggcacagactggcaaattggataaagagtcaagacccatccatgtgctgtattcaggaaaccaatctcatgtgcagagacacacataggctcaaaataaagggatggaggaagatctaccaagcaaacggaaaacaaaaaaaggcaggggtttcaatcctagtatcggataaaacagactttaaaccaacaaagatcaaaagagacaaagaaggccattacataatggtaaagggatcaattcaacaagaagaactaacactcctaaatatacatgcacccaatacaggagcacccagattcataaagcaagtccttagtgacctacaaagagacttagactcacacacaataataatgggagattttaacaccccattgtcaacattacacagatcaatgagacagaaagttaacaaggatatccaggaattgaactcagctctgcacaaagcggacctaacagacatctacagaactctccaccccaaatcaacagaatatacattcttttcagcaccaccccacacctattccaaaattgaccacatagttggaagtaaagcactcctcagcaaatgtaaaagaacagaaattataacaaactgtctctcagaccacagtgcaatcaaactagaactcaggattaagaaactcactcaaaaccactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattgaaagaactagagaagcaagagcaaacacattcaaaagctagcagaaggcaagaaataactcagatcagagcagaactgaaggaaatagagacacaaaaaacccttcaaaaaatcaatgaatccaggagctggttttttgaaaagatcaacaaaattgatagaccgctagcaagactaataaagaagaaaagagagaagaatcaaatagacgcaataaaaaatgacaaaggggatatcaccaatgatcccacagaaatacaaactaccatcagagaatactataaacacctctactcaaataaactagaaaatctagaagaaatggataaattcctcaacacatacaccctcccaagactaaaccaggaagaagttgaatctctgaatagaccaataacaggctctgaaattgagccaataattaatagcttaccaaccaaaaagagtccaggaccagatggattcacagccgaattctaccagaggtacaaggaggagctggtagcattccttctgaaactattccaatcaatagaaaaagagggaatcctccctaactcattttatgaggccagcatcatcctgataccaaagcctggctgagacacaacaaaaaaagagaattttagaccaatatccttgatgaacattgatgcaaaaatcctcaataaaatactggcaaaccgaatccagcaacacatcaaaaagcttattcaccatgatcaagtgggctttatccctgggatgcaaggctggttcaacatatgaaaatcaataaatgtaatcaagcatataaacagaaccaaagacaaaaaccacatgattatctcaatagatgcagaaaaggcctttgacaaaattcaacaacgcttcatgctaaaaatctctcaataaattaggtattgatgggacgtatctcaaaataataagagctatctatgacaaacccacagccaatatcatactgaatggacaaaaactggaagcattccctttgaaaactggcacaagacagggatgccctctctcaccactcctattcaacatagtgttggaagttctggccagggcaatcaggcaggagaaggaaataaagggcattcgattaggaaaagaggaagtcaaattatccctgtttgcagatgacatgattgtatatctagaaaaccccactgtctcagcccaaaatctccttaagctgataagcaacttcagcaaagtctcaggatacaaaatcaatgtgcaaaaatcacaagcattcttatataccaataacagatagagagccaaatcatgagcgaactcccattcacaattgcttcaaagagaatacaatacctaggaatccaacttacaagggatgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatcccccatcaagctaccaatgactttcttcacagaattggaaaaaactactttaaagttcatatggaaccaaaaaagagcctgcattgccaagtcaatcctaagccaaaagaacaaagctggagtcatcacgctacctgacttcaaactatactacaaggctacagtaaccaaaacagcatggtactggtaccaaaacagagatatagaccaatggaacagaacagagccctcagaaataatgccacatatctacaactgtctgatctttgacaaacctgagaaaaacaagcaatggggaaaggattccctatttaataaatggtgctgggaaaactggctagccacatgtagaaagctgaaactggatcccttccttacaccttatacaaaaattaattcaagatggattaaagacttacatgttagacctaaaaccataaaaaccctagaagaaaacctaggcaataccattcaggacataggcatgggccaggacttcatgtctaaaacaccaaaagcaatggcaacaaaagccaaaattgataaatgggatctaattaaactaaagagcttctgcacagcaaaagaaactaccatcagagtgaaaaggcaacctacagaaagggagaaaattttggcaacctacagaaagggagaaaatttttgcaacctactcatctgacaaagggctaatatccagaatctacagtgaactcaaacaaatttacaagaaaaaaacaaacaaccccatcagaaagtggacaaaggatatgaacagacacttctcaaaagaagacatttatgcagccaaaaaaacacatgaaaaaatgctcatcatcactggccatcagagaaatgcaaatcaaaaccacaatgagataccatctcacaccagttagaatggcgatcactaaaaagtcaggaaacaacaggtgctggagaggatgtggagaaataggaatgcttttacactgttggtgggactgtaaactagttcaaccattgtggaagtcagtgtggcgattcctcagggatctagaactagaaataccatttgacccagccatcccattactgggtatacacccaaaggattataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcctttgtagagacatggatgaagctggaaaccatcattctcagcaaactatggcaaggacaaaaaaactaaacaccgcatgttctcactcataggtgggaattgaacaatgagaacacatggacacaggaaggggaacatcacacactggggactgttgtggggtggggggatgggggagggatagcattaggagatatacctaatgtaaatgacgagttaatgggtgcagcacaccaagatggcacatgtatacatatgtaacaaacctgcacgttgtatacatgtaccctaacacttaaagtatagaaataataaaattttaa

SEQ ID NO: 23432 - DNA, 1560 bp, Homo sapiens
atggccagcaatcacaaatcttcagcagctcgccctgtttcaagaggtggagttgggttaacaggaaggcctccttctgggatacgacccctatcaggaaatattcgagtggcaactgcaatgccacctgggacagcaagaccaggttctcgtggttgtcccatagggactggtggagttctgtcttctcaaatcaaagttgcccatcgccctgtaacacaacaaggtttgactggaatgaaaactgggacgaaaggtccccagaggcaaattttagacaaatcttactatcttgggcttcttagaagtaaaataagtgaacttacaactgaagttaataaacttcagaagggaatagaaatgtacaatcaagagaattcagtatatttgtcatatgaaaagagggctgagactttagctgttgagataaaagagcttcaaggacaactagcagactacaacatgttggtagataaacttaataccaacactgaaatggaagaagtaatgaatgattacaatatgcttaaagctcaaaatgatcgagaaacacaaagtttggatgtcatatttactgaaagacaagcgaaagaaaaacaaatcagaagtgtcgaagaagaaattgaacaggaaaaacaagcaacagatgacattatcaaaaatatgtcttttgaaaaccaagtcaagtacctagagatgaaaaccacaaatgagaaactgttacaggaattagatacacttcaacaacaattggattcacagaacatgaaaaaagagagcctggaagcagaaatagctcactcccaggtgaaacaggaggcggtattgctgcatgaaaaactttatgagttggagtcccatcgagatcaaatgattgcagaagacaaaagcataggatctccaatggaagagagagagaaattacttaagcagattaaagatgataatcaggaaatagccagcatggaaagacagttaacagatacaaaagaaaagataaatcagtttattgaagaaattagacaacttgacatggatttagaggaacaccaaggtgaaatgaaccagaaatacaaggagctaaagaaaagggaggaacatatggacacttttattgagacttttgaggaaacaaagaatcaggaactgaaacgaaaggcacagatagaagccaacattgttgcactcttggagcactgcagtcgaaatataaatcgtatagaacagatatcctctatcaccaatcaagagctaaagatgatgcaggatgacctcaattttaaatctactgaagtgcagaaatcacaaagtacagctcagaatttgacttcagacattcaacgtctgcagttggatctgcagaaaatggagcttctagaaagtaagatgactgaagaacagcattctctaaaaagcaaaattaagcaaatgacaactgatctggagatatataatgatttgccagctttaaaatcatcaggtgaagaaaagataaaggtaaatgttaaccaagtcttacagaattacaattcagattgtttttttcttgatcaaatgtaa

SEQ ID NO: 23433 - DNA, 2211 bp, Homo sapiens
atgaataccaaaacaaaacaaaatgaaaaataccttgacataccatatttaaattacagaaaattcaaagatgggccaggcatggtggctcatgcctgtaatcccagcactttggggacgccgaggtgggtggatcacctgaggtcaggagtttgaaaccagcctggccaacatggtgaaaccccatctctactaaaaatacaaaaattagccaggcgtggtggctcacgcttgtaatcccagctattcgggaggctgaggtacgagaataacttgaacccgggaagcagaggttgcagtgagccgaaatcatcccactgcactccaacctaaacaacagagcaagactccatctaaaaaaaagaggaaaaaaaagtaaatggatggaaaaagatgtaccgtgctaacaccaatcaaaagaaaacaggagtcgctatattagtttcagacaaagcagacatcacagcaaggaaagttttcagggataaagaagggcactacctaatgataaaggggacaattctccaagaagacataaccatctttaacatacttgcacatagcaagagtcaaactacatgaagtaaaactaacagacctgcaaggagaagtgattaatctattattatagttggagactttaacaccaatctatcagaaataggttcagcaagcagaaaatcagtaaggacatggttgaattcaacaacaccatcaattcactggacacaagggcaactactgactacttcgtccagcaccagagtacacatttttctcaagttcacataaaacactcaccaaaatagacagattctgggccataaaacagtatcttaacaaaattttaaaaacagaagtcatacaatgcctgcttcccgaccacaatgaaattaaacaaaaaattaataacaaagatagctggaaaaatcccaaaatacttggaaattaacacatttctaagtaacacaggggtcagataattcttcaagacacaattttaaaatattttgaactaaatgaaaatgaaaacacaatttatcaaaatgtgtgagatgcagtaaaagtagtgcttaaagagaaatagcattgaatgcatatattagaaaaggagaaaactctataatcattaagcttgtaccttaggaaagtagaaagagcattaattaaagaataaaattaaatccaaagtaagcagaagacaaaaataattacagcagaaatcaaggaaatgaaaaacaagaaatcaatagagaaaatcaatgaaaccaaaagcgaatgctttgaaaagttcaataaggctaggtgtactggctcacacctataatcctagcactttgggaggctgaggtggacagatcacttgaggtcaggagtttgagactcgcctggccaacatagtgaaacctcgtctgtactaaaaatacaaaaattagctgggcatagtggcagatgcctgtaatatcagctactcaggaggctgaggcaggagaatcacttgaacccaggaggcagaggttgcagtgagccaagatcatatcattgcactccagcctgggtgacagagtgagactccgtctcaaaaaaaaaaaaaaaaaaaagttcaataaaattgataagcttctagccaagttaagaaaaaaagagaacacacattattaatgtcaaaaatgacatatttcatatttcatggacattaaaggataataatgaaatgctatgaacaactctatgcccataaatttgataaccttcatgcaacggaccaattccttaaaagacacaatctgccaaaactcatacaagaagaaatagataatccaaataggcctatatttatttttaaaattgaatcaataattggtaactttccaaacacaaagcaccaagctcagatgggtttagaggtgaattcaacaaaacatttaaagtggaaattacactgattttctataatctcttttagaagatagaagcaaagggaatacttcccaattcatcctgaggccagtataccttaatgccaaaactagacaaagacatttatttatgagaaaacaacagataaatatctctcatgaacatagatgcaaaaatcctcaacaacgagatgcttggtggtctgtggttccggagcttcctcgggatgtcagtggactggctgaggggcaaggtggaagtcaatcaagagactatccagcggctccttga

SEQ ID NO: 23434 - DNA, 1521 bp, Homo sapiens
atgtttggccttaccaaggttacagatgacacactcaagcgtttcagtgtgcgatatctgcgacctgctcgcagtcttgtcttcccttggttctcccctgggggctcaggattacgaggcctgaagctcctagaggctaaatgccagggggatggagtgagctacgaggaaaccactattccccgacccagcgcctaccacaatctgtttggattaccactgattagtcgtcgagatgctgaggtggtactgacgagtcgtgagcttgacagcctggccttgaaccagtccacggggctgcctacccttactctaccccgaggaacgacctgcttaccccctgccttactcccttacctggaacagttccggcggattgtattctggttgggggatgaccttcggtcctgggaagccgccaagttgtttgcacgaaaactgaaccccaaacgatgcttcttggtgcgaccaggagaccagcaaccccgtcccctggaggccctgaacggaggcttcaatctttctcgtattcttcgtaccgccctgcctgcctggcacaagtccatcgtatctttccggcagcttcgggaggaggtgctaggagaactgtcaaatgtggagcaagcagctggcctccgctggagccgctttccagacctcaatcgtatcttgaagggacatcgaaagggcgagctgacggtcttcacagggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggactgtaatagatacaatgcaacatgcagtctacgtctatgacatttgtcatgtgatcatcgacaacctgcagttcatgatgggtcacgagcagctgtccacagacaggatcgcagctcaagactacatcatcggggtctttcggaagtttgcaacagacaataactgccatgtgacactggtcattcacccccggaaagaggatgatgacaaggaactgcagacagcgtccatttttggctcagccaaagcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtga

SEQ ID NO: 23435 - DNA, 429 bp, Homo sapiens
atggcgttcccagacagcctgcactctgcgggctgctcccagccggggacagcaggtgaagactcctcctccccagcctcctgccttccctgccatctcatctgcatctgctgtcagacttgcgtctccctctgcctccccgcctgtctgcctccccaagaagtctcttccagagctgatcgtgtcttggcttcggtttttggaagagccgagccaacacacatcgtatttgagatacagtgggtcggaggcgatacccagggattttctccagcttggacagcgagccctttgccctctctgggtggcagggtgcctccctctaaaatgagggggcgatgcttggcagtttctagaacctgttcagatcaaggcaacctgggagttagagttccgctagtcttgtctggcagtacagtcggtctctaa

SEQ ID NO: 23436 - DNA, 690 bp, Homo sapiens
atgatccataacagaccatccctggcttctcagaccaatgtaggctctcactgcaggggcagaggaggagaccagcctgacaaaaaacctcctaggaccctgcctttacactctcgtgactgggaaatagagagtaccagcagtgagtcaaaatccagttcttccagcaagtatcgtcccacatggagacccaaacgagaatctctgaatattgacagtatctttagtaaggacaaaaggaagcactgtggctatacccagcttagccccttttctgaggattcagctaaagaatttataccagatgaaccaagcaagccaccttcttacgacattaaatttggtggaccaagcccccagtacaagcgctggggcccagcacggccaggctctcaccttttagagcagcacccccgactaatccagcgaatggaatctggctatgaaagcagtgagaggaacagcagcagccctgtcagcctggatgcagccctgcctgagagctcaaatgtctacagggatccaagtgctaagagatcagctgggttggttccttcctggcgtcatatcccaaagtcgcacagcagtagcatcctggaggtagactccacagcatccatgggtggctggacaaagagtcagcctttctctggtaagcagaatgacactgaatttgaggactggatttga

SEQ ID NO: 23437 - DNA, 228 bp, Homo sapiens
atgacacctctcttaggtaaattctctgaaggagtgattttctatgcttccatcattatagttttacagttcaataatggcttcataagcagatacctgaccaatgtatctccagccatggtggtggagaaacagcagaattacggaaaaaacaaaaactgcttgatgattaacagtgtggattttggcttggagtcttatattgaggccaactatgcactgagttaa

SEQ ID NO: 23438 - DNA, 688 bp, Homo sapiens
gctggaagccaagattgctgtgtatttggaagaaagcaaaagccaagatctgaagaccttggagctggcccagtgcacaaaaagccctttaggatgggtcttcggggaggactactgggggctcatgtgggtctgtctctgcttttttttttttaggcagagtttcgctcttgttgcccaggctggagtgcaatggtgcaatctcggctctccgaaacctctgcctcccaggttcaagtgattctcctgcctcagcctcctgagtagctgggattacaggcatgcgccaacatgcctggctaattttgtatttttagtagagacagggtttctccatgttggtcaggcttatctcaaactcctgacctcaggtgatctgcccacctcggcctcccaaagtgctgggattacaggcgtgagccaccgcgcccggcctctctctgctttaactgccatttccctacccttccccacgtgtcccacatatcccctccctctactgcctgggcccttcctcccagacctctctgctgtgccctctccgtttagtggtcttccagtgcctctgcatctgagcctcttttctgaccatctcctccaccgtctagcttcaaccgaaacctgctgtccctccgaggacaccctgcaaccctctcaggtgggggctgtttttttctctggctcttga

SEQ ID NO: 23439 - DNA, 891 bp, Homo sapiens
atgcagaaggggttaaaagataactttgctgatgtccaggtctctgtagttgattgccctgatttgactaaggaaccctttacctttcctgtaaaaggcatctgtgggagaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaa

SEQ ID NO: 23440 - DNA, 852 bp, Homo sapiens
atggacaactgtttggcggccgcagcgctgaatggggtggaccgacgttccctgcagcgttcagcaaggctggctctagaagtgctggagagggccaagaggagggcggtggactggcatgccctggagcgtcccaaaggctgcatgggggtccttgcccgggaggcgccccacctagagaaacagccggcagccggcccgcagcgcgttctcccgggagagaaatattattcatctgtgccagaggaaggaggggcaacccatgtctatcgttatcacagaggcgagtcgaagctgcacatgtgcttggacatagggaatggtcagagaaaagacagaaaaaagacatcccttggtcctggaggcagctatcaaatatcagagcatgctccagaggcatcccagcctgctgagaacatctctaaggacctctacatagaagtatatccagggacctattctgtcactgtgggctcaaatgacttaaccaagaagactcatgtggtagcagttgattctggacaaagcgtggacctggtcttccctgtttttttttgagacagtctcactctgttgcccaggctggagtgcagtggcgtgatctcggctcactgcaagttccgcctcccgggttcacaccattctcctgcctcagcctcccgagtagctggcactacaggcacccgccaccatgcccggctattttttttgtatttttagtagagacggggtttcaccatgttggccaggatggtctcgatctcttgacctcgtgatccacccaccttggcctcccaaagtgttgggattacaggcgtgagccaccgcgcccggcctcagtgccttttttaa

SEQ ID NO: 23441 - DNA, 1071 bp, Homo sapiens
atggagcaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggtgcgtaggaaaagaataggggtattttcttgttttcctaataattga

SEQ ID NO: 23442 - DNA, 273 bp, Homo sapiens
atgacaagagggaagtaccggaaaaggagagagattggaatcaacaataatgttggtttggcaggtctggaagccttcgctctccaggttgagttcattcagaagaaacaatgtagaacgtgtgctccaatgaggagacgtgtgaagagacacaggagcccctttcccagggcccatcgactctacgagctgattccattcgcctctcccaatactcctcacatccactcaccttatccagcctgtcctcactgctgtcaaaatgacctctga

SEQ ID NO: 23443 - DNA, 1131 bp, Homo sapiens
atgtccacaattgcagctttctatggcggcaagtccattctcatcacgggggccacaggctttctgggcaaagtgctgatggagaagctgtttcgcaccagcccagacctgaaagtcatttacatccttgtgaggcccaaggctggccagacactgcagcagagggttttccagatcctagacagtaagctatttgagaaagtcaaagaagtttgtccaaatgtgcatgagaagatcagagctatttatgcagatctcaatcagaatgactttgccatcagcaaagaggacatgcaggagcttctctcctgtacaaacataatatttcactgtgcagccactgtacgctttgacgacactctcagacatgctgtgcaacttaacgtcactgccacccggcagctcttgcttatggctagtcagatgccaaagctggaagcctttatacatatctctactgcctattcaaattgtaacctgaagcacatcgatgaagttatctatccgtgccctgtggagccaaaaaaaatcattgattcccttgagtggttagacgatgctattattgacgagattacacccaagctgatcagagattggcccaatatttatacctacaccaaggccttgggagaaatggtggtgcagcaagagagcaggaacctgaacattgccatcataaggccctccattgtgggagcaacttggcaggagcctttcccaggttgggttgataatataaatggacctaatggaatcattattgcgactgggaaagggtttcttcgggccataaaagctactccaatggctgtggcagacgtaattccagttgatacagtcgtcaatctcatgctagctgtaggatggtatactgcagttcacagacctaagtcaacattagtctaccacattacatctggtaacatgaatccctgcaattggcacaaaatgggagtccaagtcttggcaacctttgaaaaaatcccatttgagagacctttcaggaggccaaatgctaattttaccagcaacagcttcacatcacagtactggaatgcggtcagccaccgggcccctgccattatctatgactgctatctgcggctcactggaaggaagcccaggtga

SEQ ID NO: 23444 - DNA, 738 bp, Homo sapiens
atggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggctcattttattttgctaaaagacatttgatagagatgggttacttgcagggtggaaaaatggcatactacgaaatgcgagctgaacatagtgtggatatagatgtggatattgattggcctattgcagagcaaagagtattaagatatggctattttggcaaagagaagcttaaggaaataaaacttttggtttgcaatattgatggatgtctcaccaatggccacatttatgtatcaggagaccaaaaagaaataatatcttatgatgtaaaagatgctattgggataagtttattaaagaaaagtggtattgaggtgaggctaatctcagaaagggcctgttcaaagcagacgctgtcttctttaaaactggattgcaaaatggaagtcagtgtatcagacaagctagcagttgtagatgaatggagaaaagaaatgggcctgtgctggaaagaagtggcatatcttgtatttattttacttgataggaaatga

SEQ ID NO: 23445 - DNA, 1468 bp, Homo sapiens
atgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaaagttcctcagcagaagggcataccgatgctgtccttgacctttcatggaataagctaatcagaaatgttttagcaagtgcatcagctgacaacactgtaattctgtgggatatgtccttggggaaaccagcagctagcctcgctgtacacacagacaaggtccaaacactgcagtttcatccatttgaagcacagactctgatttctggctcatatgataagtcagtggctttgtatgactgccgaagtccagatgaaagccatcgaatgtggcgattcagtgggcagatagagagagtgacttggaatcacttttcaccttgtcatttcttggccagtacagatgacggctttgtatataatttggatgcacgttcagataagccaatttttacacttaatgcacacaatgatgaaatctctggtcttgatcttagcagtcaaatcaagggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaa

SEQ ID NO: 23446 - DNA, 2545 bp, Homo sapiens
atgcttagagatgccaggcagtggctaaatagtggtcatataaatgatgtccggcatgcaaaatctggaggtacagcacttcacgttgcagctgctaaaggctatacggaagttttaaaacttttaatacaggcaggctatgatgttaatattaaagactatgatggctggacacctcttcatgctgcagctcattggggtaaagaagaagcatgtcgaattttagtggacaatctgtgtgatatggagatggtcaacaaagtgggccaaacagcctttgatgtagcagatgaagacattttaggatatttagaagagttgcaaaagaaacaaaatctgctccatagtgaaaaacgggacaagaaatctccactaattgaatcaacagcaaatatggacaataatcagtcacagaagacctttaaaaacaaagagacgttgattattgaaccagagaaaaatgcatcccgtattgaatctctggaacaagaaaaggttgatgaagaagaagaaggaaagaaggatgagtctagctgctctagtgaagaagatgaggaagatgactcggaatcagaagctgaaacagataagacaaaacccctggcttctgtaactaatgccaacacttctagtacacaagcagctcctgtagctgttacaacacctactgtgtcatcaggtcaagcaacacctacatcacctattaaaaagtttccaaccacagctacaaaaatttctcccaaagaagaagagagaaaagatgagtctcctgcaacttggaggttaggacttagaaagacgggcagctatggtgcacttgctgaaatcacagcatctaaagagggtcagaaagaaaaagatactgcaggtgttacacgttcagcttcaagtcccagactttcctcctctttggataataaagaaaaggagaaagatagtaaaggaactaggcttgcatatgttgcacctacaataccaagacgactagccagtacatctgacattgaagagaaagaaaacagagattcttcaagtttgcgaacaagtagttcatatacaaggagaaaatgggaagatgatcttaaaaaaaatagctcagttaatgaaggatcaacgtatcataaaagttgctcctttggtagaagacaagatgatttgattagttctagtgttccaagcaccacatcaacaccaacagttacctctgcagctgggcttcagaaaagcctgctttccagcacaagcactactacaaagattacaacgggttcttcctcagcaggcacacaaagcagtacctcaaatcgtttgtgggctgaggatagtactgagaaagaaaaggacagtgttcctacggcagtgaccattcctgttgctccaactgttgtaaatgctgcagcttctaccacaaccctgactacaactactgctggcactgtctcctccacaacagaggtcagggagagacgcagatcatacctcactcctgttagggatgaagagtctgaatcccaaagaaaagcaagatctagacaagcaagacaatctagaagatcaacacagggagtgacattaactgatcttcaagaagctgagaaaacaataggaagaagtcgttctacccgaaccagagaacaagaaaatgaagaaaaagaaaaagaggaaaaagagaaacaagataaagagaaacaagaagaaaagaaggagtcagaaacatctagagaagatgaatataaacaaaagtactccagaacgtatgatgagacttaccagcgttataggccagtatcaacttcaagttcaaccactccatcctcttcactttctactatgagcagttcactgtatgcttcaagtcaactaaacaggccaaatagtcttgtaggcataacttctgcttactccagaggaataacaaaagaaaatgaaagagaggagaaagaaggagaagataaatcacaacctaaatcaatcagagaacgacgacgaccaagagagaaaagaagatctacaggagtttcattttggacacaagattgatgaaaatgaacaagaacaacaatcagacacagaagagggatccaataagaaagaaactcagacggattccatttctagatatgaaaccagttctacatcagctggtgatcgatatgattccttgctgggtcgctctggatcatacagttacttagaagaaagaaaaccttacagcagcaggctagaaaaggatgactcaactgactttaaaaagctttatgaacaaattctagctgaaaatgaaaagctgaaggcacagctacatgatacaaatatggaactaacagatcttaaattacagttggaaaaggccacccagagacaagaaagatttgctgatagatcactgttggaaatggaaaaaagggaacgaagagctctagaaagaagaatatctgaaatggaagaagagctcaaaatgttaccagacctaaaagcagacaaccagaggctaaaggatgaaaatggggccttgatcagagttataagcaaactttccaaataa

SEQ ID NO: 23447 - DNA, 543 bp, Homo sapiens
atgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctaggacggggaacgacaattacccttgtcttaaaagaagaagcatctgattaccttgaattggatacaattaaaaatctcgtcaaaaaatattcacagttcataaactttcctatttatgtatggagcagcaagactgaaactgttgaggagcccatggaggaagaagaagcagccaaagaagagaaagaagaatctgatgatgaagctgcagtagaggaagaagaagaagaaaagaaaccaaagactaaaaaagtaagtctggtttatctccctgcataa

SEQ ID NO: 23448 - DNA, 1161 bp, Homo sapiens
atggcggcttcttgccctctcccggtgaccccggacctgcccacgctgcgtgccaagttgcagggactgctgcagttcctgagggatgccctgtccatttccaatgcacataccgtggatttctacacagaatccgtgtgggaggagctggtcgacttgccaccggagacagtgctggctgcgctgaggaagtcagcgtcggagacggaggccctgccctcagagacgcgccccctagtggaagcagagtgggaagcaggtatgactgattttcccaaaatattttgtgaaacttctcagaagttggtgagtgtggaagcctttgctctggctgcgaaatactattctgtacaaaacttgggaatatgtactccttttgaacagttgcttgtagcccttcgaggaaatcaaaaccagagaattggtgaaaatcagaaggcagttgagtttatgaatatgaagaaatctcatgaagttcaggcaatgtcagagctgatcagcagtattgctgactactatggaataaagcaggtgattgacttgggttccggtaaaggctacctaagctcttttttgtccttgaagtatggcttaaaagtttatggaattgattcttcaaataccaatactcatggagctgaggagagaaacagaaaattgaagaaacattggaaactctgtcatgctcagtcaagattagatgtcaatggactagcattaaaaatggcaaaagaaaggaaagtgcaaaataaagttaaaaataaagctgatactgaggaagtgtttaacaacagtcctacaaatcaagaaaagatgcctacctcagctattttgcctgatttttctggctctgtaatttctaatatcagaaaccaaatggaaacccttcattctcagccacatcaagaagaaaatttgtgttttgaaaattccttttctcttataaaccttttgcctattaatgctgtagagcctacttcttcacagcaaatacccaacagagaaacatctgaagccaataaagagagaagaaaaatgacatcaaagtcaagtgaatcaaatatatattcacctttaacctcttttatcactgctgattcagaactccatgacattattaaagatttggaggtgactttacctttgaattatttaatttga

SEQ ID NO: 23449 - DNA, 3363 bp, Homo sapiens
atgtcggccaaggtgcggctcaagaagctggagcagctgctcctggacgggccctggcgcaacgagagcgccctgagcgtggaaacgctgctcgacgtgctcgtctgcctgtacaccgagtgcagccactcggccctgcgccgcgacaagtacgtggccgagttcctcgagtgggctaaaccatttacacagctggtgaaagaaatgcagcttcatcgagaagactttgaaataattaaagtaattggaagaggtgcttttggtgaggttgctgttgtcaaaatgaagaatactgaacgaatttatgcaatgaaaatcctcaacaagtgggagatgctgaaaagagcagagaccgcgtgcttccgagaggagcgcgatgtgctggtgaacggcgactgccagtggatcaccgcgctgcactacgcctttcaggacgagaaccacctgtacttagtcatggattactatgtgggtggtgatttactgaccctgctcagcaaatttgaagacaagcttccggaagatatggcgaggttctacattggtgaaatggtgctggccattgactccatccatcagcttcattacgtgcacagagacattaaacctgacaatgtccttttggacgtgaatggtcatatccgcctggctgactttggatcatgtttgaagatgaatgatgatggcactgtgcagtcctccgtggccgtgggcacacctgactacatctcgccggagatcctgcaggcgatggaggacggcatgggcaaatacgggcctgagtgtgactggtggtctctgggtgtctgcatgtatgagatgctctatggagaaacgccgttttatgcggagtcactcgtggagacctatgggaagatcatgaaccatgaagagcgattccagttcccatcccatgtcacggatgtatctgaagaagcgaaggacctcatccagagactgatctgcagtagagaacgccggctggggcagaatggaatagaggatttcaaaaagcatgcgttttttgaaggtctaaattgggaaaatatacgaaacctagaagcaccttatattcctgatgtgagcagtccctctgacacatccaacttcgacgtggatgacgacgtgctgagaaacacggaaatattacctcctggttctcacacaggcttttctggattacatttgccattcattggttttacattcacaacggaaagctgtttttctgatcgaggctctctgaagagcataatgcagtccaacacattaaccaaagatgaggatgtgcagcgggacctggagcacagcctgcagatggaagcttacgagaggaggattcggaggctggaacaggagaagctggagctgagcaggaagctgcaagagtccacccagaccgtgcagtccctccacggctcatctcgggccctcagcaattcaaaccgagataaagaaatcaaaaagctaaatgaagaaatcgaacgcttgaagaataaaatagcagattcaaacaggctcgagcgacagcttgaggacacagtggcgcttcgccaagagcgtgaggactccacgcagcggctgcgggggctggagaagcagcaccgcgtggtccggcaggagaaggaggagctgcacaagcaactggttgaagcctcagagcggttgaaatcccaggccaaggaactcaaagatgcccatcagcagcgaaagctggccctgcaggagttctcggagctgaacgagcgcatggcagagctccgtgcccagaagcagaaggtgtcccggcagctgcgagacaaggaggaggagatggaggtggccacgcagaaggtggacgccatgcggcaggaaatgcggagagctgagaagctcaggaaagagctggaagctcagcttgatgatgctgttgctgaggcctccaaggagcgcaagcttcgtgagcacagcgagaacttctgcaagcaaatggaaagcgagctggaggccctcaaggtgaagcaaggaggccggggagcgggtgccaccttagagcaccagcaagagatttccaaaatcaaatccgagctggagaagaaagtcttattttatgaagaggaattggtcagacgtgaggcctcccatgtgctagaagtgaaaaatgtgaagaaggaggtgcatgattcagaaagccaccagctggccctgcagaaagaaatcttgatgttaaaagataagttagaaaagtcaaagcgagaacggcataacgagatggaggaggcagtaggtacaataaaagataaatacgaacgagaaagagcgatgctgtttgatgaaaacaagaagctaactgctgaaaatgaaaagctctgttcctttgtggataaactcacagctcaaaatagacagctggaggatgagctgcaggatctggcagccaagaaggagtcagtggcccactgggaagctcagattgcggaaatcattcagtgggtcagtgacgagaaagatgcccggggttaccttcaagctcttgcttccaagatgaccgaagagctcgaggctttgaggagttctagtctggggtcaagaacactggacccgctgtggaaggtgcgccgcagccagaagctggacatgtccgcgcggctggagctgcagtcggccctggaggcggagatccgggccaagcagcttgtccaggaggagctcaggaaggtcaaggacgccaacctcaccttggaaagcaaactaaaggattccgaagccaaaaacagagaattattagaagaaatggaaattttgaagaaaaagatggaagaaaaattcagagcagatactggtaaattaatgttgtgcgattctgcattatttgaatataagtatttttcaaatgaatgtttttattttcttttcgacttaatagttactttagaagcacctacagaattccaaattcagtattttccaaaatcagcattttcaaacaacatcttcaaatatattttccccaaaggtagccattgtttttggtttatccttcctttttttttgagacagtctcgctgtgtcacccaggctggagtgcaatggcacaatctcggctcactgcaacctctgcatcctgggttcaaggattctcccgcctcagcctcgcaagtagctgggattgcaggtgcacaccaccaccacccctggctaatttttgtatttttagtagagatggggttttgccacgttggccaggctggtctgcaactcctgacctcaggcaatccacccacctcagcctcccaaagtgctggaattacaggtgtgagccaccgtgcccagcctatccttcctttcatcttgaaagcatatggcaaatccacacaaatctag

SEQ ID NO: 23450 - DNA, 1377 bp, Homo sapiens
atgatgccgtctagttttgccatgaagtgccgaaaacatttgaagagtcggagattagtcagtgcaaaacagcttggtgtggatagaattgtagattttcaatttggaagtgatgaagctgcttaccatttaatcattgagctctatgatagggggaacattgttcttacagattatgagtacgtaattttaaatattctaaggtttcgaactgatgaggcagatgatgttaaatttgctgttcgtgaacgctatccacttgatcatgctagagctgctgaacctttgcttactttggaaaggttgactgaaatagtagccagcgcacctaagggtgaactactgaagagggtgcttaacccattacttccctatggaccagctctcattgaacactgtcttttagaaaatggattctcgggtaatgtcaaagtggatgaaaaacttgaaactaaagatattgaaaaagtacttgtttctctgcagaaagcagaagactatatgaaaacaacatccaacttcagtgggaagggatatatcattcagaaaagagaaataaaaccatgcttggaagcagataaaccagttgaagacatactgacgtatgaggaatttcatcctttcttgttttctcaacattcacaatgtccatatatagaatttgaatcatttgacaaggcggtggatgaattttattccaagatagaaggccagaaaattgacttaaaagctttacaacaggaaaagcaagcattgaagaaattagataatgttcgaaaggatcacgaaaacagattggaagctcttcagcaggctcaggaaatagacaaactgaaaggagagctcatagaaatgaacctacaaatagttgacagagccattcaggtagttcgaagtgctttagctaaccagatagattggacagaaattgggttaattgtgaaagaagcccaggctcaaggagaccctgttgcaagtgcaatcaaagaattaaaactacaaacaaaccatgttacaatgctgctaagaaatccatacttgttatcagaggaggaagatgatgatgttgatggtgacgtcaatgttgagaaaaatgaaactgaaccaccaaaaggaaaaaagaaaaaacaaaagaataaacagctgcagaagcctcagaaaaataagcccttacttgtagatgttgatctcagcttgtcagcatatgccaatgccaaaaagtattatgatcacaagagatatgctgctaagaaaacacaaaagactgttgaagctgctgagaaggcattcaagtcagcagaaaagaaaacaaagcaaacattaaaagaagttcagactgttacctctattcaaaaagcaagaaaagtatattggtaa

SEQ ID NO: 23451 - DNA, 273 bp, Homo sapiens
atgtgtttgcatatttgtcactgcaactttaagcggacctctttgaattcttttcgtggaggcaagcaaaacaatgtgcgggaagaagagtggaagtggggagtgctcatggatctgcaggtcacaccaccaaaccaggatttactgattaataatggagacaggataatttttggcctcattaggaagaatgaagatgagaaatgtagactatgccttcaggtatgtctgtcctacctcaattttaagtgtacaaggaatcttttagattag

SEQ ID NO: 23452 - DNA, 390 bp, Homo sapiens
atggggatttggcagcgtctgctgctttttggtggggtgtcgctccgggctggtggcggggccactgccccgcttgggggaagccgagcgatggtttgtgggcgccagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcagtgaatcttgcacttgcactagcagcgaacgattcgtccaaggccattggtttgctagatgtggatgtgtatggaccttcagttccaaagatgatgaatctgaaaggaaatccggaattatcacagagtaagtaa

SEQ ID NO: 23453 - DNA, 1116 bp, Homo sapiens
atgcacaagcttcagtgcaacaactgtgctacaaatggagccacagagaggaaacaagcagcaggctcagaaaccaggtgtgcgctgcctttggggctccagtccatgcctcaggggtcgtatggcactgcaggcttcttggttgccaagaggaagaccacaggccgtcttgatgaggactttacgttcatgcacaagcttcagtgcaacaactgtgctacaaatggagccacagagaggaaacaagcagcaggctcaggaaccaggtgtgcgctgcctttggggctccagtccatgcctcaggggtcgtatggcactgcaggcttcttggttgccaagaggcagaccacaggccgtcttgatgaggactttacgttcggtggctggttgctctttgagccagcttggccttgccgggcatgtacaagcttcagtgcaacaactgtgctacaaatggagccacagagaggaaacaagcagcaggctcaggagcagctggaatctcaagaccatgatgacctctcatcactcctgaatccagagctttccctttacaaaggggaaactgagacctggagcagggctgatgttcagccagcgcacaagggaatggctgaattggtgaaagtggatgaccgggccaccctccaccactgcccttctgcgctcctgctggagctggcagagaccagagctgccaccgctgctgcttccaggagtgtgcaggtggcagctgccgctgagcccgcggcggaggatggcagggcttgttccagaaggcttgagggtccccgagtgcaccgccctcccaccaatttctggtttttcctgttggagcccaaggagcaagggcagaatgaggaacatgatgtttcttaccgacagttactcatgacgtctccatccaggactgaggggggcatccttctccatctaggactgggggcatccttctccatccagtattgggggtcatccttctccatccagtattgggggtcatcctcctccatccaggacctgaggggtgtccttttctgcgcttccttggatggcagtctttcccttcatgtttatagtgatttaccattaaatcactgtgccgttttttcctaa

SEQ ID NO: 23454 - DNA, 1292 bp, Homo sapiens
atggccggctctggcgcgtggaagcgcctcaaatctatgctaaggaaggatgatgcgccgctgtttttaaatgacaccagcgcctttgacttctcggatgaggcgggggacgaggggctttctcggttcaacaaacttcgagttgtggtggccgatgacggttccgaagccccggaaaggcctgttaacggggcgcacccgaccctccaggccgacgatgattccttactggaccaagacttacctttgaccaacagtcagctgagtttgaaggtggactcctgtgacaactgcagcaaacagagagagatactgaagcagagaaaggtgaaagccaggttgaccattgctgccgttctgtacttgcttttcatgattggagaacttgtaggtggatacattgcaaatagcctagcaatcatgacagatgcacttcatatgttaactgacctaagcgccatcatactcaccctgcttgctttgtggctatcatcaaaatcaccaaccaaaagattcacctttggatttcatcgcttaggtaggttttgtcagctatgattagtgtgctgttggtgtatatacttatgggattcctcttatatgaagctgtgcaaagaactatccatatgaactatgaaataaatggagatataatgctcatcaccgcagctgttggagttgcagttaatgtaataatggggtttctgttgaaccagtctggtcaccgtcactcccattcccactccctgccttcaaattcccctaccagaggttctgggtgtgaacgtaaccatgggcaggatagcctggcagtgagagctgcatttgtacatgctttgggagatttggtacagagtgttggtgtgctaatagctgcatacatcatacgattcaagccagaatacaagattgctgatcccatctgtacatacgtattttcattacttgtggcttttacaacatttcgaatcatatgggatacagtagttataatactagaaggtgtgccaagccatttgaatgtagactatatcaaagaagccttgatgaaaatagaagatgtatattcagtcgaagatttaaatatctggtctctcacttcaggaaaatctactgccatagttcacatacagctaattcctggaagttcatctaaatgggaggaagtacagtccaaagcaaaccatttattattgaacacatttggcatgtatagatgtactattcagcttcagagttacaggcaagaagtggacagaacttgtgcaaattgtcagagttctagtccctaa

SEQ ID NO: 23455 - DNA, 579 bp, Homo sapiens
atggaagaaaacataaaaaaagctattcaggtgctagacaagcatagtctgagtggaagaccactgaaagtgaaagatcctgatagtgaacatgccaggagagcaatgcaaaacgtgatggctaccactggtggaacagatatgagaccaagtggcccagaaatgattactatcccacctagtatcttaaataatcctaacatcccaaatgaaattatccatgtattacagacagaaagacttggaagcacaatatttgtagcaaatcaggattacaaacacattcttgaggataaagatgaaaaaaatcatggattgggcactgttacttttgaacagtccactgaagctgtgcaagctatatctacattcaatggccaactgctgtgtgatagaccaacgcaggtaaagacggatgagaccgccttaccaaaggatttttttttccctcctaagcgtccgcagcttccctatggccttggtggtattggaacagggttaggaccaggagggcagactatcgatgccaatcacctgaataaaggcactggaatgggaaacagggcctgcagaaattag

SEQ ID NO: 23456 - DNA, 816 bp, Homo sapiens
atggggatttttgaccaggatgtgagtgaccagaacagcgtggactgtccccagctctacaaaccaggacagctgaatctgctttttaacaagcgtaaatttttcatttgcgtgttgcatggaatctacacctcattagtccttttcttcatcccctatggggccttttacaacgtggctggagaagatgggcaacatattgctgactaccagtcctttgcagttaccatggccacatctttggtcattgtggtcagtgtgcagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggctatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagaccccgtgagcagctttagccaggataaaacagtgaaactgtga

SEQ ID NO: 23457 - DNA, 5229 bp, Homo sapiens
  misc_feature 3044: n = A,T,C or G
atggcggtggccgagctgtacacgcagtacaacagggtctggattcccgatcctgaagaagtttggaagtctgctgaaatagccaaggactacagagttggtgacaaggtcctgcgactcctgctggaggatggaacggagctggattattctgtcaatccagaatctctgcctccacttcggaatcctgacatcctcgtgggcgagaatgacctcacggctctcagctatcttcacgagcccgcggtgctccacaacctcagaatccgctttgcagaatccaaactcatttacacctacagtggaatcattttggtggccatgaatccttacaagcagttgccaatatacggagatgccatcatccacgcctacagcgggcagaacatgggcgatatggacccacacatatttgccgtggcagaagaggcatacaagcagatggccagaaacaacagaaaccagtccataattgtaagtggggagtcaggtgctggaaagacagtgtcggctcgctatgccatgaggtactttgccaccgtcagcaaatcgggcagcaacgctcacgtggaagacaaggtcctggcatccaatcccatcaccgaggccgttggaaatgccaagaccacccgcaatgacaatagtagtcggtttgggaaatacacagaaatcagttttgatgaacaaaatcaaattataggagccaacatgagcacttacctcctggagaaatccagagttgtctttcaatcggaaaatgaacgaaattaccacattttctatcagctttgtgcatctgcacagcagtcggaatttaaacatcttaaattggggagtgccgaagaatttaattatacaagaatgggaggcaatactgtcattgagggtgtgaatgatcgagctgaaatggtagagactcaaaagaccttcacgcttctgggtttcaaggaggattttcagatggacgtttttaaaatcctggcagccatcctacatctgggcaatgtgcagatcaccgcggtgggcaacgagaggtcctcagttagtgaggatgacagtcacctgaaggtgttctgtgagctcctgggcctggagagtggcagagttgctcagtggctgtgcaatcgcaaaatcgtcacaagctctgagacggtggtaaaacccatgaccaggcctcaggctgtcaacgccagggatgcactggccaaaaagatctatgctcacctgttcgacttcattgtggagagaattaaccaagcgttgcagttttcaggcaagcagcacacttttattggtgttttggacatttatggttttgaaacctttgatgtgaacagctttgaacaattttgcatcaattacgctaatgaaaaactgcaacaacagtttaacatgcatgtcttcaaactggaacaagaagaatacatgaaggaagatataccttggacgctgatagatttttatgacaatcaaccagttattgacctgattgaagcaaaaatgggaattctggagttactggatgaagaatgtttgttaccacatggaactgatgaaaactggcttcaaaagctgtataataattttgtcaacaggaaccctttgtttgaaaagcctagaatgtcaaacacatcctttgtcatccagcactttgctgataaggtagagtataaatgtgaaggtttcctggagaaaaacagagacaccgtctatgacatgctggttgaaatcctgagagcaagcaagtttcatctctgtgccaacttttttcaagaaaatccaactcctccttctccttttggttcaatgattacagttaaatctgcaaagcaagtcatcaagccaaacagcaagcatttccggaccacagttgggagcaagttccgcagctctctgtacttgctcatggagaccctcaatgcgacgacgccccactacgttcgatgcatcaagccaaatgatgagaagttaccctttgaatttgactccaaaagaattgttcagcagctgcgagcctgcggcgttttagaaacgattcgcattagtgcacagagctacccttccaggtggacatacatcgagttctacagtcgctacggcattctcatgaccaagcaagagctttccttcagcgataaaaaggaggtgtgcaaggtggttttacacagactcatccaggattctaatcagtaccagtttggtaaaaccaaaattttcttcagagcaggacaagtggcttatttagagaaacttcgattggataaactgaggcagagttgtgttatggtacaaaagcacatgcgtggctggctccagaggaaaaaattcctccgagagagacgagccgccctgataatccagcagtacttccggggtcagcaaactgtgaggaaagctattactgcagtggccttaaaagaagcttgggcagccataatcattcagaagcactgccgcgggtatcttgttcgcagcctgtatcagttgattcgcatggccaccatcacaatgcaggcctacagccgaggattcctggcaaggaggaggtatcgaaagatgctggaggaacataaggctgtgatcctacagaaatacgcacgggcgtggctggccagacgcagattccagagtatccgacgattcgtgcttaatattcagcttacttacagggtccagcgtttgcagaaaaagttggaagatcagaacaaagaaaaccatgggctggtggagaagctgactagcctggctgctcttcgagctggggatgtggaaaagattcagaagctggaagcagaactagaaaaagcagccactcacaggcgaaattacgaggagaaggggaagagatacagggatgctgtggaagagaaattggcaaagcttcagaagcataattcagaactggaaacacagaaagaacaaatacagctgaagcttcaagagaagactgaagagttaaaagaaaaaatggacaacctcaccaagcagctctttgatgatgtacaaaaggaagaacggcaaagaatgcttcttgaaaaaagttntgaactgaaaacacaagactatgagaagcagattcagtctttgaaagaagaaattaaagctctcaaggatgagaagatgcaactccaacacctggtggagggggagcacgtcacttctgatggcttgaaggcggaagtggcccgcctgagcaagcaggtcaagacaatctctgagttcgaaaaagagatagagctacttcaggcacagaagatagatgtggagaaacatgtgcagtcacaaaaacggcaaatgagagaaaagatgtcagagatcaccaaacaacttctcgaaagctatgacattgaagatgtaagaagcaggctctctgtggaagatctggaacatttaaatgaggatggagaactttggtttgcttatgaaggactaaagaaagcaacacgtgttttggagagccatttccagtctcagaaggattgctatgaaaaggagattgaagctttgaacttcaaagtggtgcatctcagtcaagaaatcaaccacctgcagaagttattcagagaagaaaatgacatcaatgaaagcatccgtcatgaagttaccaggctaacatcagagaacatgatgatcccagactttaaacagcaaatttcagaattggagaaacagaagcaagatcttgaaatccgcctgaatgaacaagctgagaaaatgaaaggaaaactagaagaattgtctaatcagttacatcgcagtcaagaggaggaaggaacacaaagaaaggccttggaagcccaaaatgaaatacataccaaagagaaggagaagctgattgataagattcaagaaatgcaggaggccagtgaccacttgaagaaacaatttgaaactgaaagtgaagtcaagtgtaacttccggcaggaagcatcccggctcactttggaaaacagggatcttgaagaagaattagacatgaaagacagagtgattaaaaagctacaagatcaagtcaagacactaagcaagacaattggaaaagccaatgatgtgcactcgtcctcaggacccaaggagtaccttggaatgctgcaatacaagagagaagacgaggccaagctcattcagaacctcattcttgacttgaagccccgtggcgtggtggtgaacatgatccccgggctgccggctcatatcctgttcatgtgtgtgcgctacgcagactctctgaatgatgccaacatgctgaagtccctcatgaacagcaccattaatggcatcaagcaggtggttaaggaacatttagaagactttgaaatgctgtccttttggctttccaacacttgtcattttctcaattgcctgaagcagtacagcggagaagaggaattcatgaagcataatagtccacagcagaataagaattgcttgaacaattttgacctttcagaatacagacagattctcagtgatgtggctatacgaatatatcatcaatttattatcataatggaaaagaatatccaaccgataatagttccgggaatgctggagtatgagagcctgcagggcatttccggcctgaagcccacaggcttccggaagcgctcctctagcatagacgacacggacggctacaccatgacctccgtcctgcaacagctgagctacttttacaccaccatgtgccagaacggcctggaccccgagcttgtgaggcaggcggtgaagcagctcttcttcttgatcggggcggtcacgctgaacagcctcttcctgcgcaaggacatgtgctcctgcagaaaagggatgcagatcaggtgcaatatcagctacttagaagaatggcttaaagataagaacttgcagaacagcttagcaaaggaaactttggagcccctctctcaggcagcctggttgcttcaggtcaagaagaccacagacagtgatgccaaggagatctacgaacgctgcacctcactgtctgctgtgcagatcataaagatccttaattcatacacacctatagatgactttgagaagagagtgactccatcctttgttcgcaaagtacaggctctcctaaatagccgggaggattcatcacagctgatgttggataccaaatatctctttcaagtcacatttccttttaccccctctccacatgctctggaaatgattcagatccccagcagtttcaagctaggctttctgaataggttatag

SEQ ID NO: 23458 - DNA, 159 bp, Homo sapiens
atgcaagccttggaagctcaaccaggcctgcatgagtacgctcagacaattgcaaagcggttccactcttctcaccatggggttcactcccattcccactatgtcccctctcagcaggaagaagccagagagatcaacggccttttcccatcttcatag

SEQ ID NO: 23459 - DNA, 1817 bp, Homo sapiens
  misc_feature 1174, 1175, 1176, 1177, 1178, 1179, 1180, 1181, 1182, 1183,1184, 1185, 1186, 1187, 1188, 1189, 1190, 1191, 1192, 1193,1194, 1195, 1196, 1197, 1198, 1199, 1200, 1201, 1202, 1203,1204, 1205, 1206, 1207, 1208, 1209, 1210, 1211, 1212: n = A,T,C or G
  misc_feature 1213, 1214, 1215, 1216, 1217, 1218, 1219, 1220, 1221, 1222,1223, 1224, 1225, 1226, 1227, 1228, 1229, 1230, 1231, 1232,1233, 1234, 1235, 1236, 1237, 1238, 1239, 1240, 1241, 1242,1243, 1244, 1245, 1246, 1247, 1248, 1249, 1250, 1251: n = A,T,C or G
  misc_feature 1252, 1253, 1254, 1255, 1256, 1257, 1258, 1259, 1260, 1261,1262, 1263, 1264, 1265, 1266, 1267, 1268, 1269, 1270, 1271,1272, 1273: n = A,T,C or G
atgagcgcgggctcggagcgcggggcggcggcaacccccgggggtttgcccgcgccctgcgcctcgaaggtggagctgcggctcagctgccggcacctgctggaccgcgacccgctcaccaagtccgaccccagcgtggcgttgctgcagcaggcgcagggccagtgggtgcaggtgggcagaaccgaggtggtccggagcagcctgcatcccgtgttctccaaggtcctcacggtggactactacttcgaggaggtgcagaggctgcgctttgaggtgtacgacacgcatgggcccagcggcttcagctgtcaggaggacgatttcctggggggcatggagtgcaccctggggcagccagcccaaaagtggcttctgcaagtcgtgatgagagtgtctgttgatgtgctgggccctgctggacactgcgctaagcacttcctgtgctgcacggaatcctcacaccttgccaggacgggtatgatgacctctgcctcccctgggcgactgctggcgccgtgaggtggtggacgtgcaggggtggccacacgcagggatggcagattgtggcccagaagaaggtgacccgcccgctgctgctcaagtttggcaggaacgctggcaagtccaccatcacggtgatcgccgaggacatctcggggaacaacggctacgtggagctctccttccgggccaggaagctggacgacaaggacctcttcagcaagtccgaccccttcctggagctctacagggtcaacgacgaccagggcttgcagctggtgtacaggacggaggtggtgaagaacaacctgaacccggtgtgggaggccttcaaagtctctctgagttccctctgcagctgcgaggagacaaggcctctaaagtgcctggtctgggattacgactctcgaggaaagcacgacttcatcggagaattctctaccaccttcgaggagatgcagaaggcctctggggaggggcaggcccagtgggactgtgtgaaccccaaatacaagcagaagagacgcagttataagaactcaggagtggtcgtcctggctgacctcaagttccacagggtgtactccttcctggactatatcatgggcggctgccagatccacttcaccgtgagtccatgccccgcccaatgccgcccggaccaggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttacccctgaggttaaaagcttttggaggccctcagtcgtgccaaaacagtgttcaagttcctggaccatgtcaaggagagaagatttcacaagggagcataccagcctatcacttctcctcttgtttcgtgtgtttcgttttcttgtttgttttttttgagatgtagtctcgctctgtcacccaggctggagtgcagtggcgtgatctcggctcactgcaacctccacctcctgggttcaagcgattctcctgcctcagcctcctgagtagctgggattacaggcacccgccaccacgcccggctaatttttgtattttcagtagagacggggtttcaccatgttggtcaggctgctcttgaaatcctgacctcgtgatccgcctgccttgtcctcccaaagtgctgggattacaggcgtgagccacggtgcccagcccacttttcctcttttttcaaaaatacacaaattacgttccctgttctgcatcctgcgttttcacttccacgacgtgcagcagcccctccatatcagcacctaa

SEQ ID NO: 23460 - DNA, 888 bp, Homo sapiens
gatcctgcctttcagatgattacaattgccaaggaaacaggccttggcctgaaggtactaggaggaattaaccggaatgaaggcccattggtatatattcaggaaattattcctggaggagactgttataaggatggtcgtttgaagccaggagatcaacttgtctcagtcaacaaggaatctatgattggtgtatcatttgaagaagcaaaaagcataattaccggagccaagttgcaagctaggaaggaagaaaaaaaagaagaatgggctctaaattatcttggtattcagcccacaaaggaacaacaccaagccctgagacagcaagtacaagcagactcaaaagggacagtgtcttttggatttgtccaggttgccagaaacttgttttgcttgcagttggatgaagtaaatgttggtgcacatgaaatttccaatatattagattcacaggaaaaattattggaatcagataagcaaaggaaacaattgacagaagagctccagaatgtgaaacaagaagccaaagctgtagttgaagaaacaagagccctgcgtagtcggattcatcttgctgaagctgctcagagacaggcacatggaatggaaatggactatgaagaagtgatccgtctgttagaggccaagattacagagctaaaggctcagcttgctgattattctgaccaaaataaagaaagaagagctgtgttagcttctcagacttccctcacaccactgggaaggaatggacgtagcatcccagcaacgctggcgcttgaatctaaggaacttgttaaatctgttcgtgccttacttgatatggatttaccttatgggtgggaggaagcttacacagcagatggaatcaagtacttcatctag

SEQ ID NO: 23461 - DNA, 1029 bp, Homo sapiens
atggatgataaacccaatcctgaagccctaagtgacagttcagagcgtcttttctcctttggcgtcatcgcagatgttcaatttgcagacttagaagatggctttaatttccaaggaaccaggcggcgatactacagacatagtcttcttcacttacagggtgccattgaagactggaataatgaaagcagcatgccctgttgtgtccttcagcttggagatatcatcgatggatataatgcacagtataatgcatccaaaaagtccctagaacttgttatggacatgttcaagaggcttaaagttccagttcatcatacatggggaaaccatgaattctataacttcagtagagagtatttaacacactctaaacttaacactaagtttctagaagatcagattgtacatcatcctgagaccatgccttcagaagattattatgcttatcattttgtaccattccctaaattccggttcattttacttgatgcatatgacttgagtgtcttgggcgtggatcagtcttctccaaaatacgagcagtgtatgaagatattgagggagcacaatccaaatacggaactgaatagtcctcaaggactttctgagccccagtttgtccagtttaatggaggattcagccaagaacagctaaactggttgaatgaagtgctaacattctctgacacaaaccaagaaaaggtggtgattgtgagccatcttcccatttacccggacgcctctgacaatgtgtgcctggcctggaactacagagatgccctggcagtcatttggtctcatgagtgtgtggtgtgtttctttgctggtcacacccatgatggtggctactctgaggatccttttggtgtataccacgtcaacctagaaggagttattgaaacagctccagacagccaagcctttggcacagttcatgtctatcctgacaaaatgatgttgaaagggagaggcagagttccagatagaattatgaattacaagaaagaaagagccttccattgttag

SEQ ID NO: 23462 - DNA, 438 bp, Homo sapiens
atgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataa

SEQ ID NO: 23463 - DNA, 435 bp, Homo sapiens
atgatgttcgtcttcaaaactctaaaaagtcaaacacattttgaatttccaagcaatgacagtttgaatatcaccaacattgaagatgatgatgatgatgatgatgattattattattattattattattattatttgagacggagttttgctctttcacccaggctggagtgcagtggtgtgatctcggctcaccgcaacctctgcctcccagtttcaagcaattctcctgcctcagcctcccaagtagctgggattacaggcgcccgacaccacgcctggctaatttttgtatttttagtagagacggggtttcaccatgttggccaggctggtctcaaactcctgacctcgtgatccacctgccttggcctcccaaagtgctgggattacaggcgtgagccactgtgcccggcctacgattattatttttaa

SEQ ID NO: 23464 - DNA, 519 bp, Homo sapiens
atgagtgactgcggtaaggatggagcagaaaggaatgctgagggaagactcctgttagaacgaggcactcttccaggactaggaatgaactcaaaggtccgtgcaggttacaagtggcgccctgaacagcgacagaatcggacgctctacaagactatatcaaaatcctccttgttctatggactaggaatgactagggctaggaatgactttgcccaataccaacaaggcagcctccaggacaagaaaagggacacgcagaggggcatgctgactgcctatagggcactcacggaacgcgggtgcacgctgcggatcctgaagccgaaagtcagggtgactgacatctgcacagcgcacacaaccaagtttacgaacccactcttaagatgcccaagtgacgttgacaagtttctctgtaaaccaatgagatctgctgaccgcgaaggcatcgcgggactgccgaaggattctgcaaaatgtggtcccggtgctctgcgggtggccagtgtgcgctga

SEQ ID NO: 23465 - DNA, 1599 bp, Homo sapiens
atgatccaggcccaggaatccataacactggaggatgtggctgtggacttcacttgggaggagtggcaactcctgggcgctgctcagaaggacctgtaccgggatgtgatgttggagaactacagcaacctggtggcagtggggtatcaagccagcaaaccggatgcactcttcaagttggaacaaggagaacaactgtggacaattgaagatggaatccacagtggagcctgttcagacatatggaaagttgatcatgtgctggagcgcttgcagagtgaaagcctggtgaacagaaggaaaccatgtcatgaacatgatgcatttgaaaatattgttcattgcagcaaaagtcagtttctgttagggcaaaatcatgatatatttgacttacgtggaaaaagtttgaaatccaatttaactttagttaaccagagcaaaggctatgaaataaagaactctgttgagtttactggaaatggggactcctttcttcatgctaaccatgaacgacttcatactgcaattaaattccctgcaagtcaaaaactcatcagcactaagtcccaattcatcagtcccaagcatcagaaaacacgaaaattagagaagcatcatgtgtgcagtgaatgtgggaaagccttcatcaagaagtcttggctaactgatcaccaggtaatgcatacaggagagaaaccccacagatgtagtctatgtgagaaagccttctccagaaagttcatgcttactgaacatcagcgaactcatacaggagaaaaaccttatgaatgccctgaatgtggcaaagcctttctcaagaaatcacggctcaacatacatcagaaaacacataccggagagaaaccctatatatgcagtgaatgtggaaaaggcttcatccagaaaggaaatctcattgtacaccagcgaattcatacaggtgagaaaccttatatatgcaatgaatgtggaaaaggcttcattcagaagacgtgtctcatagcacatcagagatttcacacaggaaagacgccctttgtgtgcagtgaatgtggaaaatcctgttctcagaaatcaggtctcattaaacatcaaagaattcacacaggagagaaaccctttgaatgtagtgaatgtgggaaagcctttagcacaaagcaaaagctcattgtccatcaaaggactcatacaggagagagaccctatggctgtaacgagtgtgggaaagcgtttgcgtatatgtcgtgtctggttaagcataagagaatacacacaagggagaaacaagaggcagccaaggtggaaaatcctcctgcagagaggcacagctcattacacaccagtgatgtcatgcaggagaaaaactctgctaacggggcgactacacaagtgccttctgtggcccctcagacatcattaaacatcagcggcctcctcgcaaacaggaacgtagtccttgtgggacagccagtggtcagatgtgcagcctcaggagataacagaggatttgcacaggacagaaaccttgtgaatgcagtgaatgtggttgtgccttccgtgatcaattatgtcttattttatgttacagaaaacccatag

SEQ ID NO: 23466 - DNA, 2918 bp, Homo sapiens
  misc_feature 2550, 2686: n = A,T,C or G
atgagaatcccccgcacatctacgccctcacggacaacatgtaccggaacatgcttatcgactgtgagaaccagtgtgtcatcattaggtatggacagaagtggagctgggaagacagtggcagccaaatatatcatgggctacatctccaaggtgtctggcggaggcgagaaggtccagcacgtcaaagatatcatcctgcagtccaacccgctgctcgaggccttcggcaacgccaagactgtgcgcaacaacaattccagccgctttggcaagtactttgagatccagttcagccgaggtggggagccagatgggggcaagatctccaacttcttgctggagaactgctggaaggggcctcccaggagcaaaggcagaacctgggcctcatgacaccggactactattactacctcaaccaatcggacacctaccaggtggacggcacggacgacagaagcgactttggtgagactctgagtgctatgcaggttattgggatcccgcccagcatccagcagctggtcctgcagctcgtggcggggatcttgcacctggggaacatcagtttctgtgaagacgggaattacgcccgagtggagagtgtggacctcctggcctttcccgcctacctgctgggcattgacagcgggcgactgcaggagaagctgaccagccgcaagatggacagccgctggggcgggcgcagcgagtccatcaatgtgaccctcaacgtggagcaggcagcctacacccgtgatgccctggccaaggggctctatgcccgcctcttcgacttcctcgtggaggcgagtggggctggggctggaaggcagagtggatgctctggggtcacaaacatttatggaagctgagtgcagtggctcacggctgcaatcccaatgctttgggtggctgagttgggagcattctttgaggccagaagttcaagaccagcctgggcaacatagcaagacccccatctctacagaaatttcaaattagttgggtgtagtggtgtgcatgtgtagttctggctactcagagggctgaggttgggggatcatttgaacccaggaggttggggctgcagtgagctatgattgcgctattgtactccagcctgggtgacagagcaagaccctgtctctaaaaaaaacttttggccagatgcagtggctcatgcctgtaatcccagcactttgggaggctgaggtggatggatcacttgaggtctggagtttgagaccagcctggccaacatggtgaaaccccctctctactaaaaattacccgggagtggtggcacatgcctttaatcccagctacttgggaggctgagggaggagaatcacttgaacctgggaggtggaggttgcagtgagctgagatcgtgctattgtattccagcctgggcaacagagagagactctgtctcaaaataaataaataaataaaataaaaacttttttaatgtatggagtcagcctgggcaacatggcaaaaccctgtctctacaaaaatacaaaaattagccgggcatggtggctggtgcctgtaatcccggctactcaggaggctgaggtggaagaatccctgaccccaggaggttgaggctgtagtgagccatgatcaagccactacactccagcctggacaacagactgagaccctgtctcaaaataaaaaataaaaataaataaagtataaaatgtatggccaggtgcagtggctcatgcctgtaatcccagcactttgggaggtcaaagcgggcagatcacccaaggtcaggagttcaagatcagccctggccagcatggcaaaaccccgtctctactaaaaatacaagaattagccgggcgtggtggcgcatgcctgtaatcccagctacttgggaggctgaggcagaagaatctcttgaatcctggaggcagaggtttcagtgagccgagattgcgccactggcattccagcctgggcaacagaatgagactccatctcaaaaaaaatagaaaagaaaaagccccataaggtagttgctattatcaaccccttttaaagataagaaaatagaggtgcaaggccgggcgcagtggctcacacctgtaatcccggcactttgggaggccgaggcgggcggatcacgaggtcaggagatcgagaccacagtgaaaccccgtctctactaaaaatacaaaaaattagccgggcgtggtggcaggcccttgtagttccagctacttgggaggctgaggcaggagaatggtgtgaaccctggaggcggagcttgcagtgagccgagatcatgccactgcactccagcctgggcgacagagtgagactccgtctcaaaaaaaaaagcaatcgccaatctccacagatttggacctcccaccggagcgaaaaccgcccccctccacaaaaccaccccagacaggcacaggaacaagactcctttcaacagcagagcccccagaatactgcaccccaaatccttacaacaactggatcccctcaatagtcaaacgccaaccacagacaaccccnaggacaaagaccttcagcacggtgactggacccacctaaccaccagatttacagagccaagctggactcccccacctcccctggagcaggtcccaagaataaggacccctacagccacacaacagccagaccctcnctggcccatgaggcatcatctttggagacctccagaccccccttcagttccctgctacacacacacaggtgttgccacccataggggcccaggattagctgctttgcagaagtgcaaggaggccatgctcttccattcacctagcacaggcctgggcgcagcagggaaacattgggcggcggcagctgtgccgtgtggggagcagggccaggtacgggggctgcacccgtag

SEQ ID NO: 23467 - DNA, 786 bp, Homo sapiens
atgtgggtcccggttgtcttcctcaccctgtccgtgacgtggattggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctgtacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 23468 - DNA, 786 bp, Homo sapiens
atggtgaggaagaagatggagataaagatgaggaagctgaggctgctgagggcaaactggctgctgaaaatgatcaggatgacaatattgttaccaagaagcagaagaccaatgaggatgaccaggcagccaaaaaggaaaattcaaacttcaagaaaaccttgccggccagtcgcaatcgctcacgcctgtaatcccaccactttgggaggttggggcaggcggatcacttgaggtcagcagttcgagaccagcctggccaacatggtgaaaccctgtctctactaaaaatacaaaaattagcagggtggcgggtgcctgagttctagctatttgggaggccgaggcaggaaaattgcttgaaccagggaggcagcggttgcagagagctgagatcgtaccactgcactccagcctgggtgacagagcaagattctatctcaacaaacaaacaaaaaactaaagataagctgggcgcggtggggctcaagcctgtaatcccagcagtttgggaggctgaggcgggtggatcacctgaggtcaggagttcgagaccagcctgaccaacatggagaaaccctgcccctactaaaaatacaaaattagccaggtgaggtgtggtggcacatgcctgtaatcccagctatttgggaggctgaggcaggagaatcacttgaacccgggaggcggaggttgcagtgagccaagattgcgccattgcactccagcctgggcaacaagagcgaaactccgtctcaaaaccacaacaacaacaaaaaaaactaa

SEQ ID NO: 23469 - DNA, 714 bp, Homo sapiens
atgtttcaatttcttagatgtaaaacgaagatcaggagcagatttgaagaattacaaagtgaattggtgccagtcagcatgtcagagacagaccacatagcctctacttcctctgataaaaatgttgggaaaacacctgaattaaaggaagactcatgcaacttgttttctggcaatgaaagcagcaaattagaaaatgagtccaaactattgtcattaaacactgataaaactttatgtcaacctaatgagcataataatcgaattgaagcccaggaaaattatattccagatcatggtggaggtgaggattcttgtgccaaaacagacacaggctcagaaaattctgaacaaatagctaattttcctagtggaaattttgctaaacatatttcaaaaacaaatgaaacagaacagaaagtaacacaaatattggtggaattaaggtcatctacatttccagaatcagctaatgaaaagacttattcagaaagcccctatgatacagactgcaccaagaaatttatttcaaaaataaagagcgtttcagcatcagaggatttgttggaagaaatacaatctgagctcttatctacggagtttgcagaacatcgagtaccaaatggaatgaataagggagaacatgcattagttctgtttgaaaagtgtgtgcaagataaatatttgcagcaggaacatatcataaaaaagtaa

SEQ ID NO: 23470 - DNA, 242 bp, Homo sapiens
gcctctgctccatcagtctccaggtggcagccagtcagactgttggaacctggccatccgtgcttccttgtgtgggtcagtttgatggctgctacatcttctccaggcacacccttgcggagaagcaagctgaaactcaagaaaggaggtgcctgctctccatcatcatggaagcaggaaaacttgccttgttggaaataagtaaaacttcagaaaaggagttgtatggcaatcaaccttag

SEQ ID NO: 23471 - DNA, 3969 bp, Homo sapiens
atgggcgggaagaacaagcagcgaactaaagggaacctgaggccttcaaacagtggccgagctgcagaactccttgccaaagaacagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagcaagctatgcaggaatttggaaccatgtgtacagagagagacacagaaactgtgaaaggagttcttccatattggccaagaattttttgcaaaatttcacttgatcatgaccgtcgcgtccgagaagccacacaacaagcttttgaaaaacttatccttaaagtaaagaaacagttggctccctacttaaaaagtttaatgggatattggctaatggctcagtgtgatacttacacaccagctgcgtttgcagcaaaagatgcatttgaagcggcttttcctccaagcaagcaacctgaagccatagcattttgtaaggatgaaattacaagtgtgctgcaggatcatcttataaaagaaacacctgatacactcagtgacccgcaaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggactgttggcttcatgtaaatgcaaaaaagagtgtgtttcccaagctatcaactgtgattcgtgaaggtggtcggggtctagctactgtcatatatccttaccttctgccattcatcagcaagctccctcagtccatcacaaatccaaagttggatttcttcaaaaatttcctcacgtctctagttgctgggctgtcaacagagagaactaaaaccagctctttagagtcctcggcagtaatatctgctttttttgaatgcttacgttttataatgcagcaaaacttaggtgaggaagagattgaacagatgctcgtcaatgatcagttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtggacttgaaatggaattctcttcttaagattattgaaaaggcatgtcctagttcagataaacatgctttagtaactccttggctcaaaggcgatatccttggtgagaaattggtcaacttggcagattgtctttgtaatgaggacttggaatccagggtatcttcagaatctcacttctcagaaagatggactcttctaagcttggtattatcccaacatgttaaaaatgattacttgattggagacgtatatgttgaaagaatcattgttagacttcatgaaactttattcaaaacaaagaaattatcagaagctgaaagcagtgactcatcagtgtcttttatctgtgatgtggcctataactatttcagctcagcgaaaggatgcttgctaatgccatcatctgaagatttattattaactctctttcagttatgtgctcagagcaaagaaaaaacacatttgccagattttcttatctgtaaactgaaaaatacttggctctctggtgtaaatttattggttcatcaaactgacagttcatataaagagagtaccttcctacatttgtctgctctgtggctgaagaaccaagttcaggcttcatctttggatatcaacagtctccaagtcctcttgtctgctgttgatgatttgctaaatacacttctagagagtgaagattcttatcttatgggagtttatattggaagtgtaatgccgaacgacagtgaatgggaaaagatgaggcagtctcttcctatgcagtggttacatagacctcttttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataattgcagaactgctttattcactgcagtggtgtgaagaattagataacccacctatttttctaattggattttgtgaaatacttcaaaaaatgaatattacgtatgataacttacgtgtacttggtaatacgtcgggccttttgcagctgttatttaacaggtccagagaacatggcacactgtggtctcttattattgctaagttgatcctttcccgaagcatttcatctgatgaagtaaaaccacattataagagaaaagaaagtttttttccactaactgaaggcaatttgcataccattcaaagtctatgtccatttttgtcaaaagaagaaaagaaagaatttagtgctcaatgtatacctgctcttttgggctggactaagaaagatctttgcagcactaatgcaattcttgtctgcaaaccaaaagtatagatgatggagagctattacatggaatattaaaaatcataatatcctggaagaaagagcatgaagatatttttcttttcagttgtaatctatcagaagcaagtccagaggtactgggtgtaaatatagaaataatccggtttctttccctatttctgaaatactgctcatcccctttggcagagagtgagtgggacttcatcatgtgctccatgttggcttggttggagacaacaagtgagaatcaggcattgtattctattccacttgtgcaactgtttgcctgtgtcagctgtgatttggcctgtgacctcagtgctttctttgattccacaactctggataccattggcaatcttcctgtaaatctaatcagtgaatggaaagaatttttttcccaaggcatccacagtttgcttttacctattttggtgactgttacaggcaagtga

SEQ ID NO: 23472 - DNA, 771 bp, Homo sapiens
atgtctgaggtctactcagtcccttttgcaaaattttgcacaacagaaagggtggacatggtgatggccatagtaggaagaaggaaattgatttgtgaggagtgtttgaatgaagagggtcatttcaagcatttcaactcctattcccaagccaaagtcatcaacatctatgtcccctggaacttcagatgtgagtgtccaatttctggttggaagtctcccaggtatctcataggaacctcaaagtcaacacgtgcaaagctgaacttaccccttttcacctgtttgttgttgttgttgttgttgtttgtttgtttgtttttgagacggagtttcactcttattccccaggctggagtgcaatggcacaatcttggctcaccacaacctccgcctcccaggttcaagtgattttcctgcctcagcctcccgagtagctgggattacaggcatgcgccaccacgcccagctaattttgtatttttagtagagatggggtttctccatgttggtcaggctggtctcgaactcccgacctcaggtgatccgcccaccttggcctcccaaagtgctgggattacaggcgtgaaccaccgcgcccggccctgtttcacctgttttgcctgtaaatctgcccccatgcctatggcctctatctgtatttcccagacgcccccaagccagaatcccggccattgtgctaagttgtcttctccctcggttcccacattcaacaagcctcaagagtttgctctgtcccatcctcactga

SEQ ID NO: 23473 - DNA, 874 bp, Homo sapiens
atggctgtagctagtgcactacaatttcctaaaaagtcttctcaccctcataggactgctctacatctggcctctgccaatggaaattcagaagtagtaaaactcctgctggacagacgatgtcaacttaatatccttgacaacaaaaagaggacagctctgacaaaggccgtacaatgccaggaagatgaatgtgcgttaatgttgctggaacatggcactgatccgaatattccagatgagtatggaaataccgctctacactatgctatctacaatgaagataaattaatggccaaagcactgctcttatacggtgctgatatcgaatcaaaaaacaagcatggcctcacaccactgttacttggtgtacatgagcaaaaacagcaagtggtgaaatttttaatcaagaaaaaagcaaatttaaatgcactggatagatatggaagaactgctctcatacttgctgtatgttgtggatcggcaagtatagtcagccttctacttgagcaaaacattgatgtatcttctcaagatctatctggacagacggccagagagtatgctgtttctagtcgtcataatgtaatttgccagttactttctgactacaaagaaaaacagatactaaaagtctcttctgaaaacagcaatccaggaaatgtctcaagaaccagaaataaataagggtggtgatagaaaggttgaagaagaaatgaagaagcacggaagtactcatatgggattcccagaaaacctgactaacggtgccactgctgacaatggtgatgatggattaattccaccaaggaaaagcagaacacctgaaagccagcaatttcctgacactgagaatgaacagtatcacaggtaa

SEQ ID NO: 23474 - DNA, 639 bp, Homo sapiens
atggccgtgagtcatgctggctgtgctcacggaatcctcctggtgatcctgtttgaccaattccaggacactgacctcaccggggatgccgctggctctgggctgtcagcccacggtcattctctgggtgccacattgggccccatgactgtggatggggttggcagacacctgctggaagcctttagccaccagtgcctgcccctaccaggggccagggccagctcaacccccaccccggccgcctggggaaagctgctccaggaagcgaaggtagtgctggccaagctgcggaaatcccgaatgtgtgggctctgggcagggaacggcccagaaaacaatgttggggccgtgtccatggagggcaggatgctggcgacggttttcaccattttgagccccagttgcaccatctccaagttggggctcatgacagtccctgcaaatgaggtcacggctcagcaggtggaagcacgctggcaccgattggaagttccagaagtgttatctgtgtggctttctcctttcccctacccccagccacatcttaaacaggaaacaccgggcttcccaaggcatactaataagcccagggaagaagagtcagacccagtgccagcgcaggggaaacgcatctaa

SEQ ID NO: 23475 - DNA, 645 bp, Homo sapiens
atgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatga

SEQ ID NO: 23476 - DNA, 669 bp, Homo sapiens
atgccgaaagtagtgtctcggtcagtagtctgctctgacactcgggaccgggaggaatatgacgacggcgagaagcccctccatgtttactactgtttgtgcggccagatggtcctagtgctggactgccagttagagaaattgcccatgaggccccgggaccggtcccgtgtgattgatgctgccaaacatgcccataagttttgtaacacagaagatgaggagactatgtatctgcggagacctgaaggcattgaacgacagtacaggaagaaatgtgcaaagtgtggactgccgctcttctaccaatcccagccaaagaatgctcctgttaccttcattgtggatggagcagtagtcaagtttggccagggctttgggaaaacgaacatatatactcagaaacaagagcctcctaagaaggtgatgatgaccaaacggaccaaagacatgggcaagttcagttctgtcaccgtgtctaccattgatgaagaggaagaggagattgaggctagggaagttgctgactcatatgcacagaatgccaaagtgattgaaaaacagctggagcgcaaaggcatgagcaagaggcgactgcaagagctggctgaattggaagccaagaaagcgaaaatgaaggggaccttgattgacaaccagttcaaataa

SEQ ID NO: 23477 - DNA, 7150 bp, Homo sapiens
atgtttgatgatgatgaatcaacactaggcagtgatgtctgctccctgaaaattcgatatgaatcctttcaggacaatgttcgagacaagactactcttttgatgcaggaagatgcccaattcaacttttttcccagcgtctttactacctgccccaagcgagagtctaagagtggggccctgaagcagagcagtgatttttcccaattcaaggtccctgatgtgagcatcatctggggggaggaagataaaaacttggacaagaagaaaggcaaagaggaaggacaggaagacaaaggtgtagagaagaaagatggaaaggataatggagaaaagcctgccttaaataaaccatgcagtgggactgaagtagagcaacttaagaatccaaagcagggccatcttgctaattccctggagacatcagggagtttcagtgatgatagttccttcattgagatctcatatgatgctatgggtgagatcaaggactgtagtcgctatatggctcgggacactaattctggcagctcctcctcccaacagaactatgggctgcgagccaagagaaaagtcagatacagtgaagattatctatatgatgttgactcactagagggtgaaaaagtaaatgagaggaaggaatggctgccagttggttccaaagaggaagatgatgatgaatggtgtcccaaaaagagaagaaaagtaacccgtaaggagccccctgttattatcaaatatatcatcattaatcgctttaaaggtgagaagaacatgctggtgaagttgggtaaggtggatgccagtgagacaacagtgaatttgagtgagaatcagctcaacaaatatgccaagctggcacccttgaaaggcttctggcaaaagaagaagaagcagagaaacaccaacacggactccatcaagacacctttttcccaaaagcaaagctttgaaccaggtagctttgaggtgtcatttctgccacctgctcgcaaacgaaaatctaaacttggcaacaggcacaggattcaaagaatcccatccattgaaatttcagcaagtagtaaacagatttcattatgtaatgatcagaggcacgctagtaatcataaagaagatggaggcctaaaaggtacactgaagtcagcacctctgggtgctcctagctgtgcaaatggatcacatttaaatgacatcacaggccctgactcagtgaaagtcaaagcccaagacacagagtttaaggggccagagaggaaagtgctcaataaaatcaaatttaaaagtgaagctaggttaaaatctaagaaagtcaaagctgctgggcaagaaagcaagccaattgttcaaatgagccctctcttggaaaaccaatcctcaaaggctaatttaaagaatgaagttattcctgggacatcaaacagttcccgtctatctgaatttcatgaggcaaaggctgctaagagttccacttttctaccaacgacatgctcttctgaaatgcctttatcatctgctaatgttaccactaatatacctgttatcccgggagggtatctgcagacattgttagatgcttctgacttgtcaaataacactagtatctcatacttcagccaccattctccagagcaaaatgaaggcagcctcactcaaaccgaaaaatcatttgtacccctccagcctacccaggactgtgtgctcacctcatcctctgactctgagctgcagcagtcatctcataacttcaaaatggaatcaagcaactatagaaatgtgtggcccaacaaggctacttctggcacccaggaattcatggctgaagtctcaagggagatagccccaacccaatccagtgaatttggagcctcccaagtagtctccatggaaaataacctcacacctacaacatacaatccaatctgtctcaatagtggtggcagtaattgcaacaaggtcctgtatgactccatgcaagatacccaactcccatctgatgactcttaccaattatgtcactttaataatggagagatctgctttcctttccagcaggggccagtcaatatggatgatggtcggctctttagctttgattcaatggccccactctctgtcagctcaagtaattattgctccttaagcttgaagtcctgtgaaaaggatggcgatgatgatatcactgatgacttcctggcccattgcagccctaagctggtgatccagcaaagcattgatgagatagcaccactaaaggagtccactgacctcctggatatatccaacttcacccctgacaaattccgccactcttccctttcagagatgtccccaccggacacccctagtctttcccctcaaattaccagatgtgagagtatgaagacactaggaacactaaaggggttccaagagggtgtcccaggaccattggacagtgtggaaaaaatcaagtgggactgcagtaccctttcacggcaggtccaaatggaggatggatttactttaaataatcaccagtttcagttccatatgttcaatgatgaggattctgtcagcctgctccaaaaaaacccttgcctgtcaacatttaatgatccatctggtcaaattagtaccaacaacaaagtgtcaaaatcaagaaagaaaagttcacccagcaagagtggggctatgaaccaaagctcttctcagaaaaacaccaggaaaaaatccctcaaaggtaacaacaaggggattgaaaaaccacctggcaaaaactcccgccaggtccctaagtccacaaagaaagggaaatacatggctgccatcaatggagagaaaatgcaaattggcattggccgtgggggaagccaaaccaacaccatatcctccactgggaagacattggctgaatgtatccaacatggtggccctatggcctctatgaagatgccaagtcaaaagggactttctggagattgggccttggggaaggagagcagcccaggctggagtgatatgagcatgggcaccaacaccaacagccttctggatgatgaccaacgggaatttcaggagccttcctatatcttgtccaacattgcctctggtatggcagatgtgcagagattcatgatggcctccatagagcccctttgggaacccatggagcaccatggggatcccaacatattctactcccctgagtccaatagtctaaaattaaaaaccctcaaaatattggctgggacaccacaggagtctaagaaaaagatcaacagtgggtcccaaggagccactaagaatcacaggtcaatcaagggtgtgagcaaaagcaatgggaaaacagcaataggtgatcctggtcgtgcaaacatgcctggttataacgaggactctcgctctaccttctttgataaaaagtatagtaacatgagcactttaggcaataacggaccgacacacaaaaagttgtatcgtcacaaatccagctccaaggccctgagagatgagaaatgtaagggaaagcacatggagcgagaacaggtccacaaggatgagtctgggacagcttcttttgaaaaactgagatgtttgatgatgatgaatcaacactaggcagtgatgtctgctccctgaaaattcgatatgaatcctttcaggacaatgttcgagacaagactactcttttgatgcaggaagatgcccaattcaacttttttcccagcgtctttactacctgccccaagcgagagtctaagagtggggccctgaagcagagcagtgatttttcccaattcaaggtccctgatgtgagcatcatctggggggaggaagataaaaacttggacaagaagaaaggcaaagaggaaggacaggaagacaaaggtgtagagaagaaagatggaaaggataatggagaaaagcctgccttaaataaaccatgcagtgggactgaagtagagcaacttaagaatccaaagcagggccatcttgctaattccctggagacatcagggagtttcagtgatgatagttccttcattgagatctcatatgatgctatgggtgagatcaaggactgtagtcgctatatggctcgggacactaattctggcagctcctcctcccaacagaactatgggctgcgagccaagagaaaagtcagatacagtgaagattatctatatgatgttgactcactagagggtgaaaaagtaaatgagaggaaggaatggctgccagttggttccaaagaggaagatgatgatgaatggtgtcccaaaaagagaagaaaagtaacccgtaaggagccccctgttattatcaaatatatcatcattaatcgctttaaaggtgagaagaacatgctggtgaagttgggtaaggtggatgccagtgagacaacagtgaatttgagtgagaatcagctcaacaaatatgccaagctggcacccttgaaaggcttctggcaaaagaagaagaagcagagaaacaccaacacggactccatcaagacacctttttcccaaaagcaaagctttgaaccaggtagctttgaggtgtcatttctgccacctgctcgcaaacgaaaatctaaacttggcaacaggcacaggattcaaagaatcccatccattgaaatttcagcaagtagtaaacagatttcattatgtaatgatcagaggcacgctagtaatcataaagaagatggaggcctaaaaggtacactgaagtcagcacctctgggtgctcctagctgtgcaaatggatcacatttaaatgacatcacaggccctgactcagtgaaagtcaaagcccaagacacagagtttaaggggccagagaggaaagtgctcaataaaatcaaatttaaaagtgaagctaggttaaaatctaagaaagtcaaagctgctgggcaagaaagcaagccaattgttcaaatgagccctctcttggaaaaccaatcctcaaaggctaatttaaagaatgaagttattcctgggacatcaaacagttcccgtctatctgaatttcatgaggcaaaggctgctaagagttccacttttctaccaacgacatgctcttctgaaatgcctttatcatctgctaatgttaccactaatatacctgttatcccgggagggtatctgcagacattgttagatgcttctgacttgtcaaataacactagtatctcatacttcagccaccattctccagagcaaaatgaaggcagcctcactcaaaccgaaaaatcatttgtacccctccagcctacccaggactgtgtgctcacctcatcctctgactctgagctgcagcagtcatctcataacttcaaaatggaatcaagcaactatagaaatgtgtggcccaacaaggctacttctggcacccaggaattcatggctgaagtctcaagggagatagccccaacccaatccagtgaatttggagcctcccaagtagtctccatggaaaataacctcacacctacaacatacaatccaatctgtctcaatagtggtggcagtaattgcaacaaggtcctgtatgactccatgcaagatacccaactcccatctgatgactcttaccaattatgtcactttaataatggagagatctgctttcctttccagcaggggccagtcaatatggatgatggtcggctctttagctttgattcaatggccccactctctgtcagctcaagtaattattgctccttaagcttgaagtcctgtgaaaaggatggcgatgatgatatcactgatgacttcctggcccattgcagccctaagctggtgatccagcaaagcattgatgagatagcaccactaaaggagtccactgacctcctggatatatccaacttcacccctgacaaattccgccactcttccctttcagagatgtccccaccggacacccctagtctttcccctcaaattaccagatgtgagagtatgaagacactaggaacactaaaggggttccaagagggtgtcccaggaccattggacagtgtggaaaaaatcaagtgggactgcagtaccctttcacggcaggtccaaatggaggatggatttactttaaataatcaccagtttcagttccatatgttcaatgatgaggattctgtcagcctgctccaaaaaaacccttgcctgtcaacatttaatgatccatctggtcaaattagtaccaacaacaaagtgtcaaaatcaagaaagaaaagttcacccagcaagagtggggctatgaaccaaagctcttctcagaaaaacaccaggaaaaaatccctcaaaggtaacaacaaggggattgaaaaaccacctggcaaaaactcccgccaggtccctaagtccacaaagaaagggaaatacatggctgccatcaatggagagaaaatgcaaattggcattggccgtgggggaagccaaaccaacaccatatcctccactgggaagacattggctgaatgtatccaacatggtggccctatggcctctatgaagatgccaagtcaaaagggactttctggagattgggccttggggaaggagagcagcccaggctggagtgatatgagcatgggcaccaacaccaacagccttctggatgatgaccaacgggaatttcaggagccttcctatatcttgtccaacattgcctctggtatggcagatgtgcagagattcatgatggcctccatagagcccctttgggaacccatggagcaccatggggatcccaacatattctactcccctgagtccaatagtctaaaattaaaaaccctcaaaatattggctgggacaccacaggagtctaagaaaaagatcaacagtgggtcccaaggagccactaagaatcacaggtcaatcaagggtgtgagcaaaagcaatgggaaaacagcaataggtgatcctggtcgtgcaaacatgcctggttataacgaggactctcgctctaccttctttgataaaaagtatagtaacatgagcactttaggcaataacggaccgacacacaaaaagttgtatcgtcacaaatccagctccaaggccctgagagatgagaaatgtaagggaaagcacatggagcgagaacaggtccacaaggatgagtctgggacagcttcttttgaaaaactgag

SEQ ID NO: 23478 - protein, 141 aa, Homo sapiens
MVAKVDEVKSTTQFQMKKVLCLAVAVGHVKMTDDELVHNIHLAVNFLVSLLKKNCQDIQALYTESTVGKPTCLHILINSTATKAKQNKIKTIKRNYLEAEYEMWYQDSSIHSNFLKSIRYSATKLCSVATGTDRKFYNWIH

SEQ ID NO: 23479 - protein, 203 aa, Homo sapiens
MSYYLSSENHLDPGPIYMRENGQLHMVNLALDGVRSSLQKPRPFRLFPKGFSVELCMNREDDTARKEKTDHFIFTYTREGNLRYSAKSLFSLVLGFISDNVDHIDSLIGFPEQIAEKLFSAAEARQKFTEPGAGLRALQKFTEAYGSLVLCSLCLRNRYLVISEKLEEIKSFRELTCLDLSCCKLGDEHELLEHLTNEALSRY

SEQ ID NO: 23480 - protein, 726 aa, Homo sapiens
MKQMTFEAQAFLEAVQFFRQEKGHYGSWEMITGDEIQILSNLVMEELLPTLQTDLLPKMKGKKNDRKRTWLGLLEEAYTLVQHQVSEGLSALKEECRALTKGLEGTIRSDMDQIVNSKNYLIGKIKAMVAQPAEKSCLESVQPFLASILEELMGPVSSGFSEVRVLFEKEVNEVSQNFQTTKDSVQLKEHLDRLMNLPLHSVKMEPCYTKVNLLHERLQDLKSRFRFPHIDLVVQRTQNYMQELMENAVFTFEQLLSPHLQGEASKTAVAIEKVKLRVLKQYDYDSSTIRKKIFQEALVQITLPTVQKALASTCKPELQKYEQFIFADHTNMIHVENVYEEILHQILLDETLKVIKEAAILKKHNLFEDNMALPSESVSSLTDLKPPTGSNQASPARRASAILPGVLGSETLSNEVFQESEEEKQPEVPSSLAKGESLSLPGPSPPPDGTEQVIISRVDDPVVNPVATEDTAGLPGTCSSELEFGGTLEDEEPAQEEPEPITASGSLKALRKLLTASVEVPVDSAPVMEEDTNGESHVPQENEEEEEKEPSQAAAIHPDNCEESEVSEREAQPPCPEAHGEELGGFPEVGSPASPPASGGLTEEPLGPMEGELPGEACTLTAHEGRGGKCTEEGDASQQEGCTLGSDPICLSESQVSEEQEEMGGQSSAAQATASVNAEEIKVARIHECQWVVEDAPNPDVLLSHKDDVKEGEGGQESFPELPSEE

SEQ ID NO: 23481 - protein, 190 aa, Homo sapiens
MFAVQPPGSDRPPSSQSDDSTRHITDTLALKPMNCPAHCLMFAHRPRSWRELPLRLADFGALHRAEASGGLGGLTRLRCFQQDDAHIFCTTDQLEAEIQSCLDFLRSVYAVLGFSFRLALSTRPSGFLGDPCLWDQAEQVLKQALKEFGEPWDLNSGDGAFYGPKVSLGPWLVVYLFIFALFSKYLIDTK

SEQ ID NO: 23482 - protein, 582 aa, Homo sapiens
MKLSLVAAMLLLLLSAARAKEEDMGTVVAIHLGTTYPCVGVFKNGRMEIIANDQGNRIMPSYVAFTPEGECLIGDAAKNQLTSNPKNTVFDAKRLIGRRWHDPSVQQDIEFLPFKVVEKNTKSYIQIDVGGGQTKTFAPKEISAMVLTKMKENAEAYLGKVTHAVVTAPAYFNDAQCQATKDAGTIADLNVMRIINKPTAAAIAYGLDKREGEKNILVFDLGGGTFDVSLLTIDNGVFKVVATNGDTYLGGEDFDQRVMEHFIKLYKKKTGKDVRKDNRAVQKLWRKVEKAKRALSSQHQASMLEDSDLKKSDIDETVLVGGFTQIPKIQQLVKEFFNGKELSRGISPYEAVAYGAAVQAGVLSGDQDTGDLVLLDICPLTLGIETVGGVMTKLIPRNTVVPTKKSQIFSTAFDNQPLQSRSMKIEVTFEMDVSDILQVTAKDKGTRYKNKITITNDQNHLTPEDIERMVNDAEKFAEEDKKLKECTDTRNELESYAYSLKNQIGDKEKLGGKLSSEDKETMEKTVEEKTEWLESHQDADTEDFKAKKKELEEIVQPIISKLYGSAGPPPTGEEDTAEKDEL

SEQ ID NO: 23483 - protein, 1261 aa, Homo sapiens
MVVSAGHWSSEKAEMNILEINETLRPQLAENKQQLRNLKEKCFLTQLAGFLANRQKKYKYEECKDLIKFMLRNERQFKEEKLAEQLKQAEELRQYKVLVHSQERELTQLKEKLREGRDASRSLNEHLQALLTPDEPDKSQGQNLQEQLAEGCRLAQHLVQKLSPENDEDEDEDVQVEEAEKVRKSSAPREVQKTEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLHPQLAEKKQQFRNLKEKCFLTQLAGFLANRQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYKSYSSTFHSLEEQQVCMAVDIGRHRWDQVKKEDHEATGPRLSRELLDEKGPEVLQDSLDRCYSTPSGCLELTDSCQPYRSAFYVLEQQRVGLAVNMDEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQRVGLAVDMDEIEKYQEVEEDQDPSCPRLSGELLDEKEPEVLQESLDRCYSTPSGCLELTDSCQPYRSAFYILEQQRVGLAVDMDEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNSMLMEVEEPEVLQDSLDICYSTPSMYFELPDSFQHYRSVFYSFEEEHISFALYVDNRFFTLTVTSLHLVFQMGVIFPQ

SEQ ID NO: 23484 - protein, 228 aa, Homo sapiens
MAVASALQFPKKSCHSHRTALHLASANGNSGVVKLLLDRRCQLNVLDNKKRTALTKAVQCQEDECALMLLEHGTDPNIPDEYGNTTLHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSHHHVICQLLSDYKEKQMLKISSENSNPENVSRTRNK

SEQ ID NO: 23485 - protein, 235 aa, Homo sapiens
MASNKATIAKANGEKERNASWSGVRGGLMQHQEFQQCPIVTKPDTLSVNIGHMGDGKKAFLSLPARGKYKVFLEFVGSVHNYDVEVTVIEKEKSMFLPNKASKLNLKRELLKHKGEFKNAVYLSGISMGPEYDDLIAHFDYCQQKYQCSQLGMARILTITENRSTDDSKHFTFSGHLHTHLQAFERMASSSHTRHWPQEPCTTSVLLDFSRAELLLPNQLLTRLRNCLPQDSRLI

SEQ ID NO: 23486 - protein, 979 aa, Homo sapiens
  VARIANT 567, 568, 963: Xaa = Any Amino Acid
MAWEARREPGPRRAAVRETVMLLLCLGVPTGRPYNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVTCGHRWKNIFYIKNENKLPTGGCYGVPPDLRTELSKRIAPCYQDYVKKFGENFASCQAGISSFYTKDLIVMGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEDVAIGAPQEDDLQGAIYIYNGRADGISSTFSQRIEGLQISKSLSMFGQSISGQIDADNNGYVDVAVGAFRSDSAVLLRTRPVVIVDASLSHPESVNRTKFDCVENGWPSVCIDLTLCFSYKGKEVPGYIVLFYNMSLDVNRKAESPPRFYFSSNGTSDVITGSIQVSSREANCRTHQAFMRVXXVRDILTPIQIEAAYHLGPHVISKRSTEEFPPLQPILQQKKEKDIMKKTINFARFCAHENCSADLQVSAKIGFLKPHENKTYLAVGSMKTLMLNVSLFNAGDDAYETTLHVKLPVGLYFIKILELEEKQINCEVTDNSGVVQLDCSIGYIYVDHLSRIDISFLLDVSSLSRAEEDLSITVHATCENEEEMDNLKHSRVTVAIPLKYEVKLTVHGFVNPTSFVYGSNDENEPETCMVEKMNLTFHVINTGNSMAPNVSVEIMVPNSFSPQTDKLFNILDVQTTTGECHFENYQRVCALEQQKSAMQTLKGIVRFLSKTDKRLLYCIKADPHCLNFLCNFGKMESGKEASVHIQLEGRPSILEMDETSALKFEIRATGFPEPNPRVIELNKDENVAHXFYWKDYIIKDPNVISP

SEQ ID NO: 23487 - protein, 270 aa, Homo sapiens
  VARIANT 263: Xaa = Any Amino Acid
MDSELKEEIPVHEEFILCGGAETQVLKCGPWTDLFHDQSVKRPKLLIFIIPGNPGFSAFYVPFAKALYSLTNRRFPVWTISHAGHALAPKDKKILTTSEDSNAQEIKDIYGLNGQIEHKLAFLRTHVPKDMKLVLIGHSIGSYFTLQMLKRVPELPVIRAFLLFPTIERMSESPNGRIATPLLCWFRYVLYVTGYLLLKPCPETIKSLLIRRGLQVMNLENEFSPLNILEPFCLANAAYLGGQEMMEVVKRDDETIKEHLCKXLHFIMVL

SEQ ID NO: 23488 - protein, 575 aa, Homo sapiens
MVLGSFGTDLMRERRDLERRTDSSISNLMDYSHRSGDFTTSSYVQDRVPSYSQGARPKENSMSTLQLNTSSTNHQLPSEHQTILSSRDSRNSLRSNFSSRESESSRSNTQPGFSYSSSRDEAPIISNSERVVSSQRPFQESSDNEGRRTTRRLLSRIASSMSSTFFSRRSSQDSLNTRSLNSENSYVSPRILTASQSRSNVPSASEVPDNRASEASQGFRFLRRRWGLSSLSHNHSSESDSENFNQESEGRNTGPWLSSSLRNRCTPLFSRRRREGRDESSRIPTSDTSSRSHIFRRESNEVVHLEAQNDPLGAAANRPQASAASSSATTGGSTSDSAQGGRNTGISGILPGSLFRFAVPPALGSNLTDNVMITVDIIPSGWNSADGKSDKTKSAPSRDPERLQKIKESLLLEDSEEEEGDLCRICQMAAASSSNLLIEPCKCTGSLQYVHQDCMKKWLQAKINSGSSLEAVTTCELCKEKLELNLEDFDIHELHRAHANEQAEYEFISSGLYLVVLLHLCEQSFSDMMGNTNEPSTRVRFINLARTLQAHMEDLETSEDDSEEDGDHNRTFDIA

SEQ ID NO: 23489 - protein, 96 aa, Homo sapiens
MILIFCTFIIDLKCILPFSLIDVGISDESAVSILHELCVDSLPTLDDEDLSVATKQCVPEKVSEPLRGPSHEKGNRIVNGKGKGENRILFKKSFDG

SEQ ID NO: 23490 - protein, 239 aa, Homo sapiens
MQDPNADTEWNDILRKKGILPPKESLKELEEEAEEEQRILQQSVVKTYEDMTLEELEDHEDEFNEEDERAIEMYRRRRLAEWKATKLKNKFGEVLEISGKDYVQEVTKAGEGLWVILHLYKQGIPLCALINQHLSGLARKFPDVKFIKAISTTCIPNYPDRNLPTIFVYLEGDIKAQFIGPLVFGGMNLTRDELEWKLSESGAIMTDLEENPKKPIEDVLLSSVRRSVLMKRDSDSEGD

SEQ ID NO: 23491 - protein, 198 aa, Homo sapiens [sequence omitted]

SEQ ID NO: 23492 - protein, 104 aa, Homo sapiens
MYGMMEQWDKYLEDFSTSGAWLPHRYEDNHHNCYSYALTFINCVLMAEGRQQLDKGEFTEKYVVPRTRLASKFITLYRAIREHGFYVTDCPQQQAQPPEGGGLC

SEQ ID NO: 23493 - protein, 282 aa, Homo sapiens
MEKRLSPKIDRDLREGGPLLYENITFVYNSEQLNGTQRVLLDNVLSEEQCRELHSVASGIMLVGDGYRGKTSPHTPNEKFEGATVLKALKSGYEGRVPLKSARLFYDISEKARRIVESYFMLNSTLYFSYTHMVCRTALSGQQDRRNDLSHPIHADNCLLDPEANECWKEPPAYTFRDYSALLYMNDDFEGGEFIFTEMDAKTVTASIKPKCGRMISFSSGGENPHGVKAVTKGKRCAVALWFTLDPLYRELERIQADEVIAILDQEQQGKHELNINPKDEL

SEQ ID NO: 23494 - protein, 363 aa, Homo sapiens
  VARIANT 15, 16, 17, 18, 19, 20, 21, 22, 23, 24, 25, 26, 27, 28, 29,30, 31, 32, 33, 34, 35, 36, 37, 38, 39, 40, 41, 42, 43,44, 45, 46, 47, 48, 49, 50, 51, 52, 53, 54, 55, 56, 57,58, 59, 60, 61, 62, 63, 64, 65, 66, 67, 68, 69, 70, 71,72: Xaa = Any Amino Acid
  VARIANT 73, 74, 75, 76, 77, 78, 79, 80, 81, 82, 83, 84, 85, 86, 87,88, 89, 90, 91, 92, 93, 94, 95, 96, 97, 98, 99, 100, 101,102, 103, 104, 105, 106, 107, 108, 109, 110, 111, 112, 113,114, 115, 116, 117, 118, 119, 120, 121, 122, 123, 124: Xaa = Any Amino Acid
  VARIANT 125, 126, 127, 128, 129, 130, 131, 132, 133, 134, 135, 136,137, 138, 139, 140, 141, 142, 143, 144, 145, 146, 147, 148,149, 150, 151, 152, 153, 154, 155, 156, 157, 158, 159, 160,161, 162, 163, 164, 165, 166, 167, 168, 169, 170, 171: Xaa = Any Amino Acid
  VARIANT 172, 173, 174, 175, 176, 177, 178, 179, 180, 181, 182, 183,184, 185, 186, 187, 188, 189, 190, 191, 192, 193, 194, 195,196, 197, 198, 199, 200, 201, 202, 203, 204, 205, 206, 207,208, 209, 210, 211, 212, 213, 214, 215, 216, 217, 218: Xaa = Any Amino Acid
  VARIANT 219, 220, 221, 222, 223, 224, 225, 226, 227, 228, 229, 230,231, 232, 233, 234, 235, 236, 237, 238, 239, 240, 241, 242,243, 244, 245, 246, 247, 248, 249, 250, 251, 252, 253, 254,255, 256, 257, 258, 259, 260, 261, 262, 263: Xaa = Any Amino Acid
MQSDNQGRVFQPCLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPPFARSRVLVLHPGRMKYVDNWKEGHMVEIEEYRKKYKKNKTRCVVNWKIQERSRKKIMKIKTILESHWGKLATVENKACSRSKDRTSNTSKMKWKLKRS

SEQ ID NO: 23495 - protein, 121 aa, Homo sapiens
  VARIANT 77: Xaa = Any Amino Acid
MADDVDQQQTTNTVEEPLDLIRLSLDERIYVKMRNDRELRGRLHAYDQHLNMILGDVEETVTTIEIDEETYEEIYKXNETEYSNALCPGRWRCPGCPSTESWLKQRICPVWKTGDFVQWPL

SEQ ID NO: 23496 - protein, 294 aa, Homo sapiens
MKDRLQELKQRTKEIELSRDSHVSTTETEEQGVFLQQAVIYEREPVAERHLHEIQKLQESINNLADNVQKFGQQQKSLVASMRRFSLLKRESTITKEIKIQAEYINRSLNDLVKEVKKSEVENGPSSVVTRILKSQHAAMFRHFQQIMFIYNDTIAAKQEKCKTFILRQLEVAGKEMSEEDVNDMLHQGKWEVFNESLLTEINITKAQLSEIEQRHKELVNLENQIKDLRDLFIQISLLVEEQGESINNIEMTVNSTKEYVNNTKEKFGLAVKYKKRNPCRVLCCWCCPCCSSK

SEQ ID NO: 23497 - protein, 143 aa, Homo sapiens
MSHAGIDNTIAYLHWEHPRHKRFRSPRRVILYKQEELGQKPSHVIPDWGFNPPFQGDGAAAGPDLVMESRQLFLSESFRKTRSRPQTHSDWRIFTYAKPAIMAMFVEGKKVGKEGINAYCLRKAGLCQYIGETIQEQLIYVKM

SEQ ID NO: 23498 - protein, 94 aa, Homo sapiens
MESSLEASFSSSGAVSGASGFLPPARSRIFKIIVIGDSNVGKTCLTYRFCAGRFPDRTEATIGVDFRERAVEIDGERIKVSGWGTVGEDRVTGV

SEQ ID NO: 23499 - protein, 1299 aa, Homo sapiens
  VARIANT 359, 486, 487: Xaa = Any Amino Acid
MASEDNRVPSPPPTGDDGGGGGREETPTEGGALSLKPGLPIRGIRMKFAVLTGLVEVGEVSNRDIVETVFNLLVGGQFDLEMNFIIQEGESINCMVDLLEKCDITCQAEVWSMFTAILKKSIRNLQVCTEVGLVEKVLGKIEKVDNMIADLLVDMLGVLASYNLTVRELKLFFSKLQGDKGRWPPHAGKLLSVLKHMPQKYGPDAFFNFPGKSAAAIALPPIAKWPYQNGFTFHTWLRMDPVNNINVDKDKPYLYCFRTSKGLGYSAHFVGGCLIVTSIKSKGKGFQHCVKFDFKPQKWYMVTIVHIYNRWKNSELRCYVNGELASYGEITWFVNTSDTFDKCFLGSSETADANRVFCXLGLGYKGTFKFKAESDLFLAEHHKLLLYDGKLSSAIAFTYNPRATDAQLCLESSPKDNPSIFVHSPHALMLQDVKAVLTHSIQSAMHSIGGVQVLFPLFAQLDYRQYLSDEIDLTICSTLLAFIMEXXLELCLAFSKYLSNLQNGMPLLKQLCDHVLLNPAIWIHTPAKVQLMLYTYLSTEFIGTVNIYNTIRRVGTVLLIMHTLKYYYWAVNPQDRSGITPKGLDGPRPNQKEMLSLRAFLLMFIKQLVMKDSGVKEDELQAILNYLLTMHEDDNLMDVLQLLVALMSEHPNSMIPAFDQRNGLRVIYKLLASKSEGIRVQALKAMGYFLKHLAPKRKAEVMLGHGLFSLLAERLMLQTNLITMTTYNVLFEILIEQIGTQVIHKQHPDPDSSVKIQNPQILKVIATLLRNSPQCPESMEVRRAFLSDMIKLFNNSRENRRSLLQCSVWQEWMLSLCYFNPKNSDEQKITEMVYAIFRILLYHAVKYEWGGWRVWVDTLSITHSKVTFEIHKENLANIFREQQGKVDEEIGLCSSTSVQAASGIRRDINVSVGSQQPDTKDSPVCPHFTTNGNENSSIEKTSSLESASNIELQTTNTSYEEMKAEQENQELPDEGTLEETLTNETRNADDLEVSSDIIEAVAISSNSFITTGKDSMTVSEVTASISSPSEEDGSEMPEFLDKSIVEEEEDDDYVELKVEGSPTEEANLPTELQDNSLSPAASEAGEKLDMFGNDDKLIFQEGKPVTEKQTDTETQDSKDSGIQTMTASGSSAMSPETTVSQIAVESDLGQMLEEGKKATNLTRETKLINDCHGSVSEASSEQKIAKLDVSNVATDTERLELKASPNVEAPQPHRHVLEISRQHEQPGQGIAPDAVNGQRRDSRSTVFRIPEFNWSQMHQRLLTDLLFSIETDIQMWRRFVYMFIMEDVYKPSLYFQRNP

SEQ ID NO: 23500 - protein, 549 aa, Homo sapiens
  VARIANT 117, 118: Xaa = Any Amino Acid
MSNKVILTLSAIATLDRIGTDGDCSKPEEKKTGEVATGMASRPNWLLAGAAFGSLVFLTHWVFGEVSLVSRWAVSGHPHPGPDPNPFGCSTAVLGKWIDASILFVVSWYWFDLVGYXXTASAAGLLYLHTWAAAVSGCVFAIFTASMWPQTLGHLINSGTNPGKTMTIAMIFYLLEIFFCAWCTAFKFVPGGVYARERSDVLLGTMMLIIGLNMLFGPKKNLDLLLQTKNSSKVLFRKSEKYMKLFLWLLVGVGLLGLGLRHKAYERKLGKVAPTKEVSAAIWPFRFGYDNEGWSSLERSAHLLNETGADFITILESDASKPYMGNNDLTMWLGEKLGFYTDFGPSTRYHTWGIMALSRYPIVKSEHHLLPSPEGEIAPAITLTVNISGKLVDFVVTHFGNHEDDLDRKLQAIAVSKLLKSSSNQVIFLGYITSAPGSRDYLQLTEHGNVKDIDSTDHDRWCEYIMYRGLIRLGYARISHAELSDSEIQMAKFRIPDDPTNYRDNQKVVIDHREVSEKIHFNPRFGSYKEGHNYENNHHFHMNTPKYFL

SEQ ID NO: 23501 - protein, 91 aa, Homo sapiens [sequence omitted]

SEQ ID NO: 23502 - protein, 256 aa, Homo sapiens [sequence omitted]

SEQ ID NO: 23503 - protein, 153 aa, Homo sapiens [sequence omitted]

SEQ ID NO: 23504 - protein, 815 aa, Homo sapiens
MPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPGKDI

SEQ ID NO: 23505 - protein, 97 aa, Homo sapiens [sequence omitted]

SEQ ID NO: 23506 - protein, 167 aa, Homo sapiens
  VARIANT 129: Xaa = Any Amino Acid
MTRWARVSTTYNKRPLPATSWEDMKKGSFEGTSQNLPKRKQLEANRLSLKNDAPQAKHKKNKKKKEYLNEDVNGFMEYLRQNSQMVHNGQIIATDSEEVREEIAVALKKDSRREGRRLKRQAAKKNAMXCVSIVENLVMELQIAPPPLKIKTWALGYVTGVGPQSTK

SEQ ID NO: 23507 - protein, 158 aa, Homo sapiens
MSSAPNGRKKRPSRSTRSSIFQISKPPLQSGDWERRGSGSESAHKTQRALDDCKMLVQEFNTQVALYRELVISIGDVSVSCPSLRAEMHKTRTKGCEMARQAHQKLAAISGPEDGEIHPEICRLYIQLQCCLEMYTTEMLKSICLLGSLQFHRKGIYI

SEQ ID NO: 23508 - protein, 239 aa, Homo sapiens
MEHGPKAVTIANSPSKPSEKDSVVSLESQKTPADPKLKTLSQTKKNKGSDSSLSGNSDGGEEFCEEEKEYFDDSTEERFYKQSSMSEDSDSGDDFFIGKVRRTRKKESSCHSSVKEQKPLEKVFLKEDTGETHGDTRNDKIKPSTETRKLESVFFHSLSGSKSSRRNFKEQAPKTRSLDFPQNEPQIKNQFNKKLSGRLENTKQQLQLPLHPSWEASRRRKEQQSNIAVFQGKKITFDD

SEQ ID NO: 23509 - protein, 332 aa, Homo sapiens
MSEILCQWLNKELKVSRTVSPKSFAKAFSSGYLLGEVLHKFELQDDFSEFLDSRVSSAKLNNFSRLEPTLNLLGVQFDQNVAHGIITEKPGVATKLLYQLYIALQKKKKSGLTGVEMQTMQRLTNLRLQNMKSDTFQEQYLNRRRQNEIMAKIQAAIIQIPKPASNRTLKALEAQKMMKKKKEAEDVADEIKKFEALIKKDLQAKESASKTSLDTAGQTTTDLLNTYSDDEYIKKIQKRLEEDAFAREQREKRRRKLLMDQLIAHEAQEEAYREEQLINRLMRQSQQERRIAVQLMHVRHEKEVLWQNRIFREKQHEERRLKDFQDALDREA

SEQ ID NO: 23510 - protein, 134 aa, Homo sapiens
MSGFPGENINICWSPDGQTIAVGNKDDVVTFIDAKTHRSKAEEQFKFEVNEISWNNDNNMFFLTNGNGCINILSYPELKPVQSINAHPSNCICIKFDPMGKYFATGSADALVSLWDVDELVCAGLACKNPQFQP

SEQ ID NO: 23511 - protein, 92 aa, Homo sapiens
GSAQLLMLDSLVPQEVCQSPEEPLPPTQSGTGVEFYHTGENLALPKCPASSNSYSLEATKWYELAPTHPLPGVSGPYQGSEVIFSLGGNKDM

SEQ ID NO: 23512 - protein, 537 aa, Homo sapiens
MVVSSLVIGALLASLTGGVLIDRYGRRTAIILSSCLLGLGSLVLILSLSYTVLIVGRIAIGVSISLSSIATCVYIAEIAPQHRRGLLVSLNELMIVIGILSAYISNYAFANVFHGWKYMFGLVIPLGVLQAIAMYFLPPSPRFLVMKGQEGAASKVLGRLRALSDTTEELTVIKSSLKDEYQYSFWDLFRSKDNMRTRIMIGLTLVFFVQITGQPNILFYASTVLKSVGFQSNEAASLASTGVGVVKVISTIPATLLVDHVGSKTFLCIGSSVMAASLVTMGIVNLNIHMNFTHICRSHNSINQSLDESVIYGPGNLSTNNNTLRDHFKGISSHSRSSLMPLRNDVDKRGETTSASLLNAGLSHTEYQIVTDPGDVPAFLKWLSLASLLVYVAAFSIGLGPMPWLVLSEIFPGGIRGRAMALTSSMNWGINLLISLTFLTVTDLIGLPWVCFIYTIMSLASLLFVVMFIPETKGCSLEQISMELAKVNYVKNNICFMSHHQEELVPKQPQKRKPQEQLLECNKLCGRGQSRQLSPET

SEQ ID NO: 23513 - protein, 740 aa, Homo sapiens
MATANSIIVLDDDDEDEAAAQPGPSHPLPNAASPGAEAPSSSEPHGARGSSSSGGKKCYKLENEKLFEEFLELCKMQTADHPEVVPFLYNRQQRAHSLFLASAEFCNILSRVLSRARSRPAKLYVYINELCTVLKAHSAKKKLNLAPAATTSNEPSGNNPPTHLSLDPTNAENTASQSPRTRGSRRQIQRLEQLLALYVAEIRRLQEKELDLSELDDPDSAYLQEARLKRKLIRLFGRLCELKDCSSLTGRVIEQRIPYRGTRYPEVNRRIERLINKPGPDTFPDYGDVLRAVEKAAARHSLGLPRQQLQLMAQDAFRDVGIRLQERRHLDLIYNFGCHLTDDYRPGVDPALSDPVLARRLRENRSLAMSRLDEVISKYAMLQDKSEEGERKKRRARLQGTSSHSADTPEASLDSGEGPSGMASQGCPSASRAETDDEDDEESDEEEEEEEEEEEEEATDSEEEEDLEQMQEGQEDDEEEDEEEEAAAGKDGDKSPMSSLQISNEKNLEPGKQISRSSGEQQNKGRIVSPSLLSEEPLAPSSIDAESNGEQPEELTLEEESPVSQLFELEIEALPLDTPSSVETDISSSRKQSEEPFTTVLENGAGMVSSTSFNGGVSPHNWGDSGPPCKKSRKEKKQTGSGPLGNSYVERQRSVHEKNGKKICTLPSPPSPLASLAPVADSSTRVDSPSHGLVTSSLCIPSPARLSQTPHSQPPRPGTCKTSVATQCDPEEIIVLSDSD

SEQ ID NO: 23514 - protein, 87 aa, Homo sapiens
ACLNFLKLCKIKYYNYCLIHNVQRDFIIQTGDPTGTGRGGESIFGQLYGDQASFFEAEKVPRIKHKKKGTVSMVNNGSDQHGSQVRK

SEQ ID NO: 23515 - protein, 129 aa, Homo sapiens
  VARIANT 1: Xaa = Any Amino Acid
XIFLKKFYALHNWFLKMDFMETKEKCFYGKKQKASIQRIKKPVHELNQLQIGLGGITYTTEISKHYNAVLFLSPQNIANQHTMESYVVIRRTQDLNLALTKTTIYFPSLYYWKTREMGGSWGEHGKFKD

SEQ ID NO: 23516 - protein, 392 aa, Homo sapiens [sequence omitted]

SEQ ID NO: 23517 - protein, 87 aa, Homo sapiens
  VARIANT 1: Xaa = Any Amino Acid
XQPSSSQREQDGQGFQELTVTSEMFRKGKGSFCSHPHPEKFLRAGGRGLRLEESLEEKQNLLGWQRSSVARKAIPSGEIHGYRLTEA

SEQ ID NO: 23518 - protein, 248 aa, Homo sapiens
MGYPRLGGEGGKGGDVWVVAQNRMTLKQLKDRYPRKRFVAGVGANSKISALKGSKGKDCEIPVPVGISVTDENGKIIGELNKENDRILVAQGGLGGKLLTNFLPLKGQKRIIHLDLKLIADVGLVGFPNAGKSSLLSCVSHAKPAIADYAFTTLKPELGKIMYSDFKQISVADLPGLIEGAHMNKGMGHKFLKHIERTRQLLFVVDISGFQLSSHTQYRTAFETIILLTKVVGIVQRGTSDKTCTLGS

SEQ ID NO: 23519 - protein, 158 aa, Homo sapiens
MAGKQAVSASGKWLDGIRKWYYNAAGFNKLGLMRDDTIYEDEDVKEAIRRLPENLYNDRMFRIKRALDLNLKHQILPKEQWTKYEEVFAVPALHSASYLDEKISPLSVPPDPKKSFCEANSHPLNCIETRQRPENFYLEPYLKEVIRERKEREEWAKK

SEQ ID NO: 23520 - protein, 127 aa, Homo sapiens [sequence omitted]

SEQ ID NO: 23521 - protein, 324 aa, Homo sapiens
MTDAGQPHSEADYTLGPLLCRGDKSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVMPGVEPGCAGHCSTYGHLCRNGGRCREKRRGVTCDCAFSAYDGPFCSNEISAYFATGSSMTYHFQEHYTLSENSSSLVSSLYRDVTLTREMITLSFRTTRSPSLLLYVSSFYEEYLSVILANNGEYLLCKEKENPELEK

SEQ ID NO: 23522 - protein, 302 aa, Homo sapiens
MSEDEEKVKLRRLEPAIQKFIKIVIPTDLERLRKHQINIEKYQRCRIWDKLHEEHINAGRTVQQLRSNIREIEKLCLKVRKDDLVLLKRMIDPVKEEASAATAEFLQLHLESVEELKKQFNDEETLLQPPLTRSMTVGGAFHTTEAEASSQSLTQIYALPEIPQDQNAAESWETLEADLIELSQLVTDFSLLVNSQQEKIDSIADHVNSAAVNVEEGTKNLGKAAKYKLAALPVAGALIGGMVGGPIGLLAGFKVAGIAAALGGGVLGFTGGKLIQRKKQKMMEKLTSSCPDLPSQTDKKCS

SEQ ID NO: 23523 - protein, 788 aa, Homo sapiens
MNHLEGSAEVEVTDEAAGGEVNESVEADLEHPEVEEEQQQPPQQQHYVGRHQRGRALEDLRAQLGQEEEERGECLARSASTESGFHNHTDTAEGDVIAAARDGYDAERAQDPEDESAYAVQYRPEAEEYTEQAEAEHAEATPRRALPNHLQFHSLEPEEAMNAAYSGYVYTHRLFHRGEDEPYSEPYADYGGLQEHVYEEIGDAPELDARDGLRLYEQERDEAAAYRQEALGARLHHYDERSDGESDSPEKEAEFAPYPRMDSYEQEEDIDQIVAEVKQSMSSQSLDKAAEDMPEAEQDLERPPTPAGGRPDSPGLQAPAGQQRAVGPAGGGEAEQRYSKEKRDAISLAIKDIKEAIEEVKTRTIRSPYTPDEPKEPIWVMRQDISPTRDCDDQRPIDGDSPSPGSSSPLGAESSSTSLHPSDPVEASTNKESRKSLASFPTYVEVPGPCDPEDLIDGIIFAANYLGSTQLLSDKTPSKNVRMMQAQEAVSRIKMAQKLAKSRKKAPEGESQPMTEVDLFISTQRIKVLNADTQETMMDHPLRTISYIADIGNIVVLMARRRMPRSNSQENVEASHPSQDGKRQYKMICHVFESEDAQLIAQSIGQAFSVAYQEFLRANGINPEDLSQKEYSDLLNTQDMYNDDLIHFSKSENCKDVFIEKQKGEILGVVIVESGWGSILPTVIIANMMHGGPAEKSGKLNIGDQIMSINGTSLVGLPLSTCQSIIKGLKNQSRVKLNIVRCPPVTTVLIRRPDLRYQLGFSVQNGIVSRTPSTPFSTMLTNKNVAWL

SEQ ID NO: 23524 - protein, 519 aa, Homo sapiens
MASNHKSSAARPVSRGGVGLTGRPPSGIRPLSGNIRVATAMPPGTARPGSRGCPIGTGGVLSSQIKVAHRPVTQQGLTGMKTGTKGPQRQILDKSYYLGLLRSKISELTTEVNKLQKGIEMYNQENSVYLSYEKRAETLAVEIKELQGQLADYNMLVDKLNTNTEMEEVMNDYNMLKAQNDRETQSLDVIFTERQAKEKQIRSVEEEIEQEKQATDDIIKNMSFENQVKYLEMKTTNEKLLQELDTLQQQLDSQNMKKESLEAEIAHSQVKQEAVLLHEKLYELESHRDQMIAEDKSIGSPMEEREKLLKQIKDDNQEIASMERQLTDTKEKINQFIEEIRQLDMDLEEHQGEMNQKYKELKKREEHMDTFIETFEETKNQELKRKAQIEANIVALLEHCSRNINRIEQISSITNQELKMMQDDLNFKSTEVQKSQSTAQNLTSDIQRLQLDLQKMELLESKMTEEQHSLKSKIKQMTTDLEIYNDLPALKSSGEEKIKVNVNQVLQNYNSDCFFLDQM

SEQ ID NO: 23525 - protein, 506 aa, Homo sapiens
MFGLTKVTDDTLKRFSVRYLRPARSLVFPWFSPGGSGLRGLKLLEAKCQGDGVSYEETTIPRPSAYHNLFGLPLISRRDAEVVLTSRELDSLALNQSTGLPTLTLPRGTTCLPPALLPYLEQFRRIVFWLGDDLRSWEAAKLFARKLNPKRCFLVRPGDQQPRPLEALNGGFNLSRILRTALPAWHKSIVSFRQLREEVLGELSNVEQAAGLRWSRFPDLNRILKGHRKGELTVFTGPTGSGKTTFISEYALDLCSQGVNTLWGSFEISNVRLARVMLTQFAEGRLEDQLDKYDHWADRFEDLPLYFMTFHGQQSIRTVIDTMQHAVYVYDICHVIIDNLQFMMGHEQLSTDRIAAQDYIIGVFRKFATDNNCHVTLVIHPRKEDDDKELQTASIFGSAKASQEADNVLILQDRKLVTGPGKRYLQVSKNRFDGDVGVFPLEFNKNSLTFSIPPKNKARLKKIKDDTGPVAKKPSSGKKGATTQNSEICSGQAPTPDQPDTSKRSK

SEQ ID NO: 23526 - protein, 142 aa, Homo sapiens [sequence omitted]

SEQ ID NO: 23527 - protein, 229 aa, Homo sapiens
MIHNRPSLASQTNVGSHCRGRGGDQPDKKPPRTLPLHSRDWEIESTSSESKSSSSSKYRPTWRPKRESLNIDSIFSKDKRKHCGYTQLSPFSEDSAKEFIPDEPSKPPSYDIKFGGPSPQYKRWGPARPGSHLLEQHPRLIQRMESGYESSERNSSSPVSLDAALPESSNVYRDPSAKRSAGLVPSWRHIPKSHSSSILEVDSTASMGGWTKSQPFSGKQNDTEFEDWI

SEQ ID NO: 23528 - protein, 75 aa, Homo sapiens
MTPLLGKFSEGVIFYASIIIVLQFNNGFISRYLTNVSPAMVVEKQQNYGKNKNCLMINSVDFGLESYIEANYALS

SEQ ID NO: 23529 - protein, 228 aa, Homo sapiens
  VARIANT 48, 49, 50, 51, 52, 53, 54, 55, 56, 57, 58, 59, 60, 61, 62,63, 64, 65, 66, 67, 68, 69, 70, 71, 72, 73, 74, 75, 76,77, 78, 79, 80, 81, 82, 83, 84, 85, 86, 87, 88, 89, 90,91, 92, 93, 94, 95, 96, 97, 98, 99, 100, 101, 102, 103,104: Xaa = Any Amino Acid
  VARIANT 105, 106, 107, 108, 109, 110, 111, 112, 113, 114, 115, 116,117, 118, 119, 120, 121, 122, 123, 124, 125, 126, 127, 128,129, 130, 131, 132, 133, 134, 135, 136, 137, 138, 139, 140,141, 142, 143, 144, 145: Xaa = Any Amino Acid
LEAKIAVYLEESKSQDLKTLELAQCTKSPLGWVFGEDYWGLMWVCLCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSALTAISLPFPTCPTYPLPLLPGPFLPDLSAVPSPFSGLPVPLHLSLFSDHLLHRLASTETCCPSEDTLQPSQVGAVFFSGS

SEQ ID NO: 23530 - protein, 296 aa, Homo sapiens
MQKGLKDNFADVQVSVVDCPDLTKEPFTFPVKGICGRTRIAEVGGVPYLLPLVNQKKVYDLNKIAKEIKLPGAFILGAGAGPFQTLGFNSEFMPVIQTESEHKPPVNGSYFAHVNPADGGCLLEKYSEKCHDFQCALLANLFASEGQPGKVIEVKAKRRTGPLNFVTCMRETLEKHYGNKPIGMGGTFIIQKGKVKSHIMPAEFSSCPLNSDEEVNKWLHFYEMKAPLVCLPVFVSRDPGFDLRLEHTHFFSRHGEGGHYHYDTTPDIVEYLGYFLPAEFLYRIDQPKETHSIGRD

SEQ ID NO: 23531 - protein, 182 aa, Homo sapiens
MDNCLAAAALNGVDRRSLQRSARLALEVLERAKRRAVDWHALERPKGCMGVLAREAPHLEKQPAAGPQRVLPGEKYYSSVPEEGGATHVYRYHRGESKLHMCLDIGNGQRKDRKKTSLGPGGSYQISEHAPEASQPAENISKDLYIEVYPGTYSVTVGSNDLTKKTHVVAVDSGQSVDLVFP

SEQ ID NO: 23532 - protein, 356 aa, Homo sapiens
MEQVNELKEKGNKALSVGNIDDALQCYSEAIKLDPHNHVLYSNRSAAYAKKGDYQKAYEDGCKTVDLKPDWGKGYSRKAAALEFLNRFEEAKRTYEEGLKHEANNPQLKEGLQNMEARLAERKFMNPFNMPNLYQKLESDPRTRTLLSDPTYRELIEQLRNKPSDLGTKLQDPRIMTTLSVLLGVDLGSMDEEEEIATPPPPPPPKKETKPEPMEEDLPENKKQALKEKELGNDAYKKKDFDTALKHYDKAKELDPTNMTYITNQAAVYFEKGDYNKCRELCEKAIEVGRENREDYRQIAKAYARIGNSYFKEEKYKDAIHFYNKSLAEHRTPDVLKKCQQVRRKRIGVFSCFPNN

SEQ ID NO: 23533 - protein, 90 aa, Homo sapiens
MTRGKYRKRREIGINNNVGLAGLEAFALQVEFIQKKQCRTCAPMRRRVKRHRSPFPRAHRLYELIPFASPNTPHIHSPYPACPHCCQNDL

SEQ ID NO: 23534 - protein, 376 aa, Homo sapiens
MSTIAAFYGGKSILITGATGFLGKVLMEKLFRTSPDLKVIYILVRPKAGQTLQQRVFQILDSKLFEKVKEVCPNVHEKIRAIYADLNQNDFAISKEDMQELLSCTNIIFHCAATVRFDDTLRHAVQLNVTATRQLLLMASQMPKLEAFIHISTAYSNCNLKHIDEVIYPCPVEPKKIIDSLEWLDDAIIDEITPKLIRDWPNIYTYTKALGEMVVQQESRNLNIAIIRPSIVGATWQEPFPGWVDNINGPNGIIIATGKGFLRAIKATPMAVADVIPVDTVVNLMLAVGWYTAVHRPKSTLVYHITSGNMNPCNWHKMGVQVLATFEKIPFERPFRRPNANFTSNSFTSQYWNAVSHRAPAIIYDCYLRLTGRKPR

SEQ ID NO: 23535 - protein, 245 aa, Homo sapiens
MVDIVGNIQATSPCLHPTDLQKVAEMIREEGYDSVFSVVRRHQFRWSEIQKGVREVTEPLNLNPAKRPRRQDWDGELYENGSFYFAKRHLIEMGYLQGGKMAYYEMRAEHSVDIDVDIDWPIAEQRVLRYGYFGKEKLKEIKLLVCNIDGCLTNGHIYVSGDQKEIISYDVKDAIGISLLKKSGIEVRLISERACSKQTLSSLKLDCKMEVSVSDKLAVVDEWRKEMGLCWKEVAYLVFILLDRK

SEQ ID NO: 23536 - protein, 489 aa, Homo sapiens
  VARIANT 236: Xaa = Any Amino Acid
MNRSRQVTCVAWVRCGVAKETPDKVELSKEEVKRLIAEAKEKLQEEGGGSDEEETGSPSEDGMQSARTQARPREPLEDGDPEDDRTLDDDELAEYDLDKYDEEGDPDAETLGESLLGLTVYGSNDQDPYVTLKDTEQYEREDFLIKPSDNLIVCGRAEQDQCNLEVHVYNQEEDSFYVHHDILLSAYPLSVEWLNFDPSPDDSTGNYIAVGNMTPVIEVWDLDIVDSLEPVFTLGXSSSAEGHTDAVLDLSWNKLIRNVLASASADNTVILWDMSLGKPAASLAVHTDKVQTLQFHPFEAQTLISGSYDKSVALYDCRSPDESHRMWRFSGQIERVTWNHFSPCHFLASTDDGFVYNLDARSDKPIFTLNAHNDEISGLDLSSQIKGCLVTASADKYVKIWDILGDRPSLVHSRDMKMGVLFCSSCCPDLPFIYAFGGQKEGLRVWDISTVSSVNEAFGRRERLVLGSARNSSISGPFGSRSSDTPMES

SEQ ID NO: 23537 - protein, 848 aa, Homo sapiens
  VARIANT 645: Xaa = Any Amino Acid
MLRDARQWLNSGHINDVRHAKSGGTALHVAAAKGYTEVLKLLIQAGYDVNIKDYDGWTPLHAAAHWGKEEACRILVDNLCDMEMVNKVGQTAFDVADEDILGYLEELQKKQNLLHSEKRDKKSPLIESTANMDNNQSQKTFKNKETLIIEPEKNASRIESLEQEKVDEEEEGKKDESSCSSEEDEEDDSESEAETDKTKPLASVTNANTSSTQAAPVAVTTPTVSSGQATPTSPIKKFPTTATKISPKEEERKDESPATWRLGLRKTGSYGALAEITASKEGQKEKDTAGVTRSASSPRLSSSLDNKEKEKDSKGTRLAYVAPTIPRRLASTSDIEEKENRDSSSLRTSSSYTRRKWEDDLKKNSSVNEGSTYHKSCSFGRRQDDLISSSVPSTTSTPTVTSAAGLQKSLLSSTSTTTKITTGSSSAGTQSSTSNRLWAEDSTEKEKDSVPTAVTIPVAPTVVNAAASTTTLTTTTAGTVSSTTEVRERRRSYLTPVRDEESESQRKARSRQARQSRRSTQGVTLTDLQEAEKTIGRSRSTRTREQENEEKEKEEKEKQDKEKQEEKKESETSREDEYKQKYSRTYDETYQRYRPVSTSSSTTPSSSLSTMSSSLYASSQLNRPNSLVGITSAYSRGITKENERXRRKKEKINHNLNQSENDDDQERKEDLQEFHFGHKIDENEQEQQSDTEEGSNKKETQTDSISRYETSSTSAGDRYDSLLGRSGSYSYLEERKPYSSRLEKDDSTDFKKLYEQILAENEKLKAQLHDTNMELTDLKLQLEKATQRQERFADRSLLEMEKRERRALERRISEMEEELKMLPDLKADNQRLKDENGALIRVISKLSK

SEQ ID NO: 23538 - protein, 180 aa, Homo sapiens
MTREELVKNLGTIAKSGTSEFLNKMTEAQEDGQSTSELIGQFGVGFYSAFLVADKVIVTSKHNNDTQHIWESDSNEFSVIADPRGNTLGRGTTITLVLKEEASDYLELDTIKNLVKKYSQFINFPIYVWSSKTETVEEPMEEEEAAKEEKEESDDEAAVEEEEEEKKPKTKKVSLVYLPA

SEQ ID NO: 23539 - protein, 386 aa, Homo sapiens
MAASCPLPVTPDLPTLRAKLQGLLQFLRDALSISNAHTVDFYTESVWEELVDLPPETVLAALRKSASETEALPSETRPLVEAEWEAGMTDFPKIFCETSQKLVSVEAFALAAKYYSVQNLGICTPFEQLLVALRGNQNQRIGENQKAVEFMNMKKSHEVQAMSELISSIADYYGIKQVIDLGSGKGYLSSFLSLKYGLKVYGIDSSNTNTHGAEERNRKLKKHWKLCHAQSRLDVNGLALKMAKERKVQNKVKNKADTEEVFNNSPTNQEKMPTSAILPDFSGSVISNIRNQMETLHSQPHQEENLCFENSFSLINLLPINAVEPTSSQQIPNRETSEANKERRKMTSKSSESNIYSPLTSFITADSELHDIIKDLEVTLPLNYLI

SEQ ID NO: 23540 - protein, 1000 aa, Homo sapiens
MSAKVRLKKLEQLLLDGPWRNESALSVETLLDVLVCLYTECSHSALRRDKYVAEFLEWAKPFTQLVKEMQLHREDFEIIKVIGRGAFGEVAVVKMKNTERIYAMKILNKWEMLKRAETACFREERDVLVNGDCQWITALHYAFQDENHLYLVMDYYVGGDLLTLLSKFEDKLPEDMARFYIGEMVLAIDSIHQLHYVHRDIKPDNVLLDVNGHIRLADFGSCLKMNDDGTVQSSVAVGTPDYISPEILQAMEDGMGKYGPECDWWSLGVCMYEMLYGETPFYAESLVETYGKIMNHEERFQFPSHVTDVSEEAKDLIQRLICSRERRLGQNGIEDFKKHAFFEGLNWENIRNLEAPYIPDVSSPSDTSNFDVDDDVLRNTEILPPGSHTGFSGLHLPFIGFTFTTESCFSDRGSLKSIMQSNTLTKDEDVQRDLEHSLQMEAYERRIRRLEQEKLELSRKLQESTQTVQSLHGSSRALSNSNRDKEIKKLNEEIERLKNKIADSNRLERQLEDTVALRQEREDSTQRLRGLEKQHRVVRQEKEELHKQLVEASERLKSQAKELKDAHQQRKLALQEFSELNERMAELRAQKQKVSRQLRDKEEEMEVATQKVDAMRQEMRRAEKLRKELEAQLDDAVAEASKERKLREHSENFCKQMESELEALKVKQGGRGAGATLEHQQEISKIKSELEKKVLFYEEELVRREASHVLEVKNVKKEVHDSESHQLALQKEILMLKDKLEKSKRERHNEMEEAVGTIKDKYERERAMLFDENKKLTAENEKLCSFVDKLTAQNRQLEDELQDLAAKKESVAHWEAQIAEIIQWVSDEKDARGYLQALASKMTEELEALRSSSLGSRTLDPLWKVRRSQKLDMSARLELQSALEAEIRAKQLVQEELRKVKDANLTLESKLKDSEAKNRELLEEMEILKKKMEEKFRADTGKLMLCDSALFEYKYFSNECFYFLFDLIVTLEAPTEFQIQYFPKSAFSNNIFKYIFPKGS

SEQ ID NO: 23541 - protein, 458 aa, Homo sapiens
MMPSSFAMKCRKHLKSRRLVSAKQLGVDRIVDFQFGSDEAAYHLIIELYDRGNIVLTDYEYVILNILRFRTDEADDVKFAVRERYPLDHARAAEPLLTLERLTEIVASAPKGELLKRVLNPLLPYGPALIEHCLLENGFSGNVKVDEKLETKDIEKVLVSLQKAEDYMKTTSNFSGKGYIIQKREIKPCLEADKPVEDILTYEEFHPFLFSQHSQCPYIEFESFDKAVDEFYSKIEGQKIDLKALQQEKQALKKLDNVRKDHENRLEALQQAQEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYW

SEQ ID NO: 23542 - protein, 90 aa, Homo sapiens
MCLHICHCNFKRTSLNSFRGGKQNNVREEEWKWGVLMDLQVTPPNQDLLINNGDRIIFGLIRKNEDEKCRLCLQVCLSYLNFKCTRNLLD

SEQ ID NO: 23543 - protein, 129 aa, Homo sapiens
MGIWQRLLLFGGVSLRAGGGATAPLGGSRAMVCGRQLSGAGSETLKQRRTQIMSRGLPKQKPIEGVKQVIVVASGKGGVGKSTTAVNLALALAANDSSKAIGLLDVDVYGPSVPKMMNLKGNPELSQSK

SEQ ID NO: 23544 - protein, 374 aa, Homo sapiens [sequence omitted]

SEQ ID NO: 23545 - protein, 430 aa, Homo sapiens
  VARIANT 181: Xaa = Any Amino Acid
MAGSGAWKRLKSMLRKDDAPLFLNDTSAFDFSDEAGDEGLSRFNKLRVVVADDGSEAPERPVNGAHPTLQADDDSLLDQDLPLTNSQLSLKVDSCDNCSKQREILKQRKVKARLTIAAVLYLLFMIGELVGGYIANSLAIMTDALHMLTDLSAIILTLLALWLSSKSPTKRFTFGFHRLGXVLSAMISVLLVYILMGFLLYEAVQRTIHMNYEINGDIMLITAAVGVAVNVIMGFLLNQSGHRHSHSHSLPSNSPTRGSGCERNHGQDSLAVRAAFVHALGDLVQSVGVLIAAYIIRFKPEYKIADPICTYVFSLLVAFTTFRIIWDTVVIILEGVPSHLNVDYIKEALMKIEDVYSVEDLNIWSLTSGKSTAIVHIQLIPGSSSKWEEVQSKANHLLLNTFGMYRCTIQLQSYRQEVDRTCANCQSSSP

SEQ ID NO: 23546 - protein, 192 aa, Homo sapiens
MEENIKKAIQVLDKHSLSGRPLKVKDPDSEHARRAMQNVMATTGGTDMRPSGPEMITIPPSILNNPNIPNEIIHVLQTERLGSTIFVANQDYKHILEDKDEKNHGLGTVTFEQSTEAVQAISTFNGQLLCDRPTQVKTDETALPKDFFFPPKRPQLPYGLGGIGTGLGPGGQTIDANHLNKGTGMGNRACRN

SEQ ID NO: 23547 - protein, 271 aa, Homo sapiens
MGIFDQDVSDQNSVDCPQLYKPGQLNLLFNKRKFFICVLHGIYTSLVLFFIPYGAFYNVAGEDGQHIADYQSFAVTMATSLVIVVSVQIALDTSYWTFINHVFIWGSIAIYFSILFTMHSNGIFGIFPNQFPFVGNARHSLTQKCIWLVILLTTVASVMPVVAFRFLKVDLYPTLSDQIRRWQKAQKKARPPSSRRPRTRRSSSRRSGYAFAHQEGYGELITSGKNMRAKNPPPTSGLEKTHYNSTSWIENLCKKTTDPVSSFSQDKTVKL

SEQ ID NO: 23548 - protein, 1742 aa, Homo sapiens
  VARIANT 1015: Xaa = Any Amino Acid
MAVAELYTQYNRVWIPDPEEVWKSAEIAKDYRVGDKVLRLLLEDGTELDYSVNPESLPPLRNPDILVGENDLTALSYLHEPAVLHNLRIRFAESKLIYTYSGIILVAMNPYKQLPIYGDAIIHAYSGQNMGDMDPHIFAVAEEAYKQMARNNRNQSIIVSGESGAGKTVSARYAMRYFATVSKSGSNAHVEDKVLASNPITEAVGNAKTTRNDNSSRFGKYTEISFDEQNQIIGANMSTYLLEKSRVVFQSENERNYHIFYQLCASAQQSEFKHLKLGSAEEFNYTRMGGNTVIEGVNDRAEMVETQKTFTLLGFKEDFQMDVFKILAAILHLGNVQITAVGNERSSVSEDDSHLKVFCELLGLESGRVAQWLCNRKIVTSSETVVKPMTRPQAVNARDALAKKIYAHLFDFIVERINQALQFSGKQHTFIGVLDIYGFETFDVNSFEQFCINYANEKLQQQFNMHVFKLEQEEYMKEDIPWTLIDFYDNQPVIDLIEAKMGILELLDEECLLPHGTDENWLQKLYNNFVNRNPLFEKPRMSNTSFVIQHFADKVEYKCEGFLEKNRDTVYDMLVEILRASKFHLCANFFQENPTPPSPFGSMITVKSAKQVIKPNSKHFRTTVGSKFRSSLYLLMETLNATTPHYVRCIKPNDEKLPFEFDSKRIVQQLRACGVLETIRISAQSYPSRWTYIEFYSRYGILMTKQELSFSDKKEVCKVVLHRLIQDSNQYQFGKTKIFFRAGQVAYLEKLRLDKLRQSCVMVQKHMRGWLQRKKFLRERRAALIIQQYFRGQQTVRKAITAVALKEAWAAIIIQKHCRGYLVRSLYQLIRMATITMQAYSRGFLARRRYRKMLEEHKAVILQKYARAWLARRRFQSIRRFVLNIQLTYRVQRLQKKLEDQNKENHGLVEKLTSLAALRAGDVEKIQKLEAELEKAATHRRNYEEKGKRYRDAVEEKLAKLQKHNSELETQKEQIQLKLQEKTEELKEKMDNLTKQLFDDVQKEERQRMLLEKSXELKTQDYEKQIQSLKEEIKALKDEKMQLQHLVEGEHVTSDGLKAEVARLSKQVKTISEFEKEIELLQAQKIDVEKHVQSQKRQMREKMSEITKQLLESYDIEDVRSRLSVEDLEHLNEDGELWFAYEGLKKATRVLESHFQSQKDCYEKEIEALNFKVVHLSQEINHLQKLFREENDINESIRHEVTRLTSENMMIPDFKQQISELEKQKQDLEIRLNEQAEKMKGKLEELSNQLHRSQEEEGTQRKALEAQNEIHTKEKEKLIDKIQEMQEASDHLKKQFETESEVKCNFRQEASRLTLENRDLEEELDMKDRVIKKLQDQVKTLSKTIGKANDVHSSSGPKEYLGMLQYKREDEAKLIQNLILDLKPRGVVVNMIPGLPAHILFMCVRYADSLNDANMLKSLMNSTINGIKQVVKEHLEDFEMLSFWLSNTCHFLNCLKQYSGEEEFMKHNSPQQNKNCLNNFDLSEYRQILSDVAIRIYHQFIIIMEKNIQPIIVPGMLEYESLQGISGLKPTGFRKRSSSIDDTDGYTMTSVLQQLSYFYTTMCQNGLDPELVRQAVKQLFFLIGAVTLNSLFLRKDMCSCRKGMQIRCNISYLEEWLKDKNLQNSLAKETLEPLSQAAWLLQVKKTTDSDAKEIYERCTSLSAVQIIKILNSYTPIDDFEKRVTPSFVRKVQALLNSREDSSQLMLDTKYLFQVTFPFTPSPHALEMIQIPSSFKLGFLNRL

SEQ ID NO: 23549 - protein, 52 aa, Homo sapiens
MQALEAQPGLHEYAQTIAKRFHSSHHGVHSHSHYVPSQQEEAREINGLFPSS

SEQ ID NO: 23550 - protein, 605 aa, Homo sapiens
  VARIANT 160, 392, 393, 394, 395, 396, 397, 398, 399, 400, 401, 402,403, 404, 405, 406, 407, 408, 409, 410, 411, 412, 413, 414,415, 416, 417, 418, 419, 420, 421, 422, 423, 424, 425, 471,472, 473, 474, 475, 476, 477, 478, 479, 480, 481, 482: Xaa = Any Amino Acid
  VARIANT 483, 484, 485, 486, 487, 488, 489, 490, 491, 492, 493, 494,495, 496, 497, 498, 499, 500, 501, 502, 503, 504, 505, 506,507, 508, 509, 510, 511, 512, 513, 514, 515, 516, 517, 518,519, 520, 521, 522, 523, 524, 525, 526, 527, 528, 529: Xaa = Any Amino Acid
  VARIANT 530, 531, 532, 533, 534, 535, 536, 537, 538, 539, 540, 541,542, 543, 544, 545, 546, 547, 548, 549, 550, 551, 552, 553,554, 555, 556, 557, 558, 559, 560, 561, 562, 563, 564, 565,566, 567, 568, 569, 570, 571, 572: Xaa = Any Amino Acid
MSAGSERGAAATPGGLPAPCASKVELRLSCRHLLDRDPLTKSDPSVALLQQAQGQWVQVGRTEVVRSSLHPVFSKVLTVDYYFEEVQRLRFEVYDTHGPSGFSCQEDDFLGGMECTLGQPAQKWLLQVVMRVSVDVLGPAGHCAKHFLCCTESSHLARTXYDDLCLPWATAGAVRWWTCRGGHTQGWQIVAQKKVTRPLLLKFGRNAGKSTITVIAEDISGNNGYVELSFRARKLDDKDLFSKSDPFLELYRVNDDQGLQLVYRTEVVKNNLNPVWEAFKVSLSSLCSCEETRPLKCLVWDYDSRGKHDFIGEFSTTFEEMQKASGEGQAQWDCVNPKYKQKRRSYKNSGVVVLADLKFHRVYSFLDYIMGGCQIHFTVSPCPAQCRPDQVXXXXXXXXXXXXXXXXXXXXXXXXXXXXXXXXXXFTPEVKSFWRPSVVPKQCSSSWTMSRREDFTREHTSLSLLLLFRVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFPLFSKIHKLRSLFCILRFHFHDVQQPLHIST

SEQ ID NO: 23551 - protein, 300 aa, Homo sapiens
DPAFQMITIAKETGLGLKVLGGINRNEGPLVYIQEIIPGGDCYKDGRLKPGDQLVSVNKESMIGVSFEEAKSIITGAKLSQARKEEKKEEWALNYLGIQPTKEQHQALRQQVQADSKGTVSFGDFVQVARNLFCLQLDEVNVGAHEISNILDSQEKLLESDKQRKQLTEELQNVKQEAKAVVEETRALRSRIHLAEAAQRQAHGMEMDYEEVIRLLEAKITELKAQLADYSDQNKSERRAVLASQTSLTPLGRNGRSIPATLALESKELVKSVRALLDMDCLPYGWEEAYTADGIKYFIN

SEQ ID NO: 23552 - protein, 342 aa, Homo sapiens
MDDKPNPEALSDSSERLFSFGVIADVQFADLEDGFNFQGTRRRYYRHSLLHLQGAIEDWNNESSMPCCVLQLGDIIDGYNAQYNASKKSLELVMDMFKRLKVPVHHTWGNHEFYNFSREYLTHSKLNTKFLEDQIVHHPETMPSEDYYAYHFVPFPKFRFILLDAYDLSVLGVDQSSPKYEQCMKILREHNPNTELNSPQGLSEPQFVQFNGGFSQEQLNWLNEVLTFSDTNQEKVVIVSHLPIYPDASDNVCLAWNYRDALAVIWSHECVVCFFAGHTHDGGYSEDPFGVYHVNLEGVIETAPDSQAFGTVHVYPDKMMLKGRGRVPDRIMNYKKERAFHC

SEQ ID NO: 23553 - protein, 145 aa, Homo sapiens [sequence omitted]

SEQ ID NO: 23554 - protein, 44 aa, Homo sapiens
MMFVFKTLKSQTHFEFPSNDSLNITNIEDDDDDDDDYYYYYYYY

SEQ ID NO: 23555 - protein, 172 aa, Homo sapiens
MSDCGKDGAERNAEGRLLLERGTLPGLGMNSKVRAGYKWRPEQRQNRTLYKTISKSSLFYGLGMTRARNDFAQYQQGSLQDKKRDTQRGMLTAYRALTERGCTLRILKPKVRVTDICTAHTTKFTNPLLRCPSDVDKFLCKPMRSADREGIAGLPKDSAKCGPGALRVASVR

SEQ ID NO: 23556 - protein, 532 aa, Homo sapiens
MIQAQESITLEDVAVDFTWEEWQLLGAAQKDLYRDVMLENYSNLVAVGYQASKPDALFKLEQGEQLWTIEDGIHSGACSDIWKVDHVLERLQSESLVNRRKPCHEHDAFENIVHCSKSQFLLGQNHDIFDLRGKSLKSNLTLVNQSKGYEIKNSVEFTGNGDSFLHANHERLHTAIKFPASQKLISTKSQFISPKHQKTRKLEKHHVCSECGKAFIKKSWLTDHQVMHTGEKPHRCSLCEKAFSRKFMLTEHQRTHTGEKPYECPECGKAFLKKSRLNIHQKTHTGEKPYICSECGKGFIQKGNLIVHQRIHTGEKPYICNECGKGFIQKTCLIAHQRFHTGKTPFVCSECGKSCSQKSGLIKHQRIHTGEKPFECSECGKAFSTKQKLIVHQRTHTGERPYGCNECGKAFAYMSCLVKHKRIHTREKQEAAKVENPPAERHSSLHTSDVMQEKNSANGATTQVPSVAPQTSLNISGLLANRNVVLVGQPVVRCAASGDNRGFAQDRNLVNAVNVVVPSVINYVLFYVTENP

SEQ ID NO: 23557 - protein, 291 aa, Homo sapiens
  VARIANT 116: Xaa = Any Amino Acid
MRIPRTSTPSRTTCTGTCLSTVRTSVSSLGMDRSGAGKTVAAKYIMGYISKVSGGGEKVQHVKDIILQSNPLLEAFGNAKTVRNNNSSRFGKYFEIQFSRGGEPDGGKISNFLLEXLLEGASQEQRQNLGLMTPDYYYYLNQSDTYQVDGTDDRSDFGETLSAMQVIGIPPSIQQLVLQLVAGILHLGNISFCEDGNYARVESVDLLAFPAYLLGIDSGRLQEKLTSRKMDSRWGGRSESINVTLNVEQAAYTRDALAKGLYARLFDFLVEASGAGAGRQSGCSGVTNIYG

SEQ ID NO: 23558 - protein, 261 aa, Homo sapiens
MWVPVVFLTLSVTWIGAAPLILSRIVGGWECEKHSQPWQVLVASRGRAVCGGVLVHPQWVLTAAHCIRNKSVILLGRHSLFHPEDTGQVFQVSHSFPHPLYDMSLLKNRFLRPGDDSSHDLMLLRLSEPAELTDAVKVMDLPTQEPALGTTCYASGWGSIEPEEFLTPKKLQCVDLHVISNDVCAQVHPQKVTKFMLCAGRWTGGKSTCSGDSGGPLVCNGVLQGITSWGSEPCALPERPSLYTKVVHYRKWIKDTIVANP

SEQ ID NO: 23559 - protein, 55 aa, Homo sapiens
MVRKKMEIKMRKLRLLRANWLLKMIRMTILLPRSRRPMRMTRQPKRKIQTSRKPC

SEQ ID NO: 23560 - protein, 237 aa, Homo sapiens
MFQFLRCKTKIRSRFEELQSELVPVSMSETDHIASTSSDKNVGKTPELKEDSCNLFSGNESSKLENESKLLSLNTDKTLCQPNEHNNRIEAQENYIPDHGGGEDSCAKTDTGSENSEQIANFPSGNFAKHISKTNETEQKVTQILVELRSSTFPESANEKTYSESPYDTDCTKKFISKIKSVSASEDLLEEIQSELLSTEFAEHRVPNGMNKGEHALVLFEKCVQDKYLQQEHIIKK

SEQ ID NO: 23561 - protein, 79 aa, Homo sapiens
LCSISLQVAASQTVGTWPSVLPCVGQFDGCYIFSRHTLAEKQAETQERRCLLSIIMEAGKLALLEISKTSEKELYGNQP

SEQ ID NO: 23562 - protein, 1323 aa, Homo sapiens
  VARIANT 84, 1165: Xaa = Any Amino Acid
MGGKNKQRTKGNLRPSNSGRAAELLAKEQGTVPGFIGFGTSQSDLGYVPAIQGAEEIDSLVDSDFRMVLRKLSKKDVTTKLKAXAMQEFGTMCTERDTETVKGVLPYWPRIFCKISLDHDRRVREATQQAFEKLILKVKKQLAPYLKSLMGYWLMAQCDTYTPAAFAAKDAFEAAFPPSKQPEAIAFCKDEITSVLQDHLIKETPDTLSDPQTVPEEEREAKFYRVVTCSLLALKRLLCLLPDNELDSLEEKFKSLLSQNKFWKYGKHSVPQIRSAYFELVSALCQRIPQLMKEEASKVSPSVLLSIDDSDPIVCPALWEAVLYTLTTIEDCWLHVNAKKSVFPKLSTVIREGGRGLATVIYPYLLPFISKLPQSITNPKLDFFKNFLTSLVAGLSTERTKTSSLESSAVISAFFECLRFIMQQNLGEEEIEQMLVNDQLIPFIDAVLKDPGLQHGQLFNHLAETLSSWEAKADTEKDEKTAHNLENVLIHFWERLSEICVAKISEPEADVESVLGVSNLLQVLQKPKSSLKSSKKKNGKVRFADEILESNKENEKCVSSEGEKIEGWELTTEPSLTHNSSGLLSPLRKKPLEDLVCKLADISINYVNERKSEQHLRFLSTLLDSFSSSRVFKMLLGDEKQSIVQAKPLEIAKLVQKNPAVQFLYQKLIGWLNEDQRKDFGFLVDILYSALRCCDNDMERKKVLDDLTKVDLKWNSLLKIIEKACPSSDKHALVTPWLKGDILGEKLVNLADCLCNEDLESRVSSESHFSERWTLLSLVLSQHVKNDYLIGDVYVERIIVRLHETLFKTKKLSEAESSDSSVSFICDVAYNYFSSAKGCLLMPSSEDLLLTLFQLCAQSKEKTHLPDFLICKLKNTWLSGVNLLVHQTDSSYKESTFLHLSALWLKNQVQASSLDINSLQVLLSAVDDLLNTLLESEDSYLMGVYIGSVMPNDSEWEKMRQSLPMQWLHRPLLEGRLSLNYECFKTDFKEQDIKTLPSHLCTSALLSKMVLIALRKETVLENNELEKIIAELLYSLQWCEELDNPPIFLIGFCEILQKMNITYDNLRVLGNTSGLLQLLFNRSREHGTLWSLIIAKLILSRSISSDEVKPHYKRKESFFPLTEGNLHTIQSLCPFLSKEEKKEFSAQCIPALLGWTKKDLCSTNXNSCLQTKSIDDGELLHGILKIIISWKKEHEDIFLFSCNLSEASPEVLGVNIEIIRFLSLFLKYCSSPLAESEWDFIMCSMLAWLETTSENQALYSIPLVQLFACVSCDLACDLSAFFDSTTLDTIGNLPVNLISEWKEFFSQGIHSLLLPILVTVTGK

SEQ ID NO: 23563 - protein, 256 aa, Homo sapiens
  VARIANT 99, 100, 101, 102, 103, 104, 105, 106, 107, 108, 109, 110,111, 112, 113, 114, 115, 116, 117, 118, 119, 120, 121, 122,123, 124, 125, 126, 127, 128, 129, 130, 131, 132, 133, 134,135, 136, 137, 138, 139, 140, 141, 142, 143, 144, 145: Xaa = Any Amino Acid
  VARIANT 146, 147, 148, 149, 150, 151, 152, 153, 154, 155, 156, 157,158, 159, 160, 161, 162, 163, 164, 165, 166, 167, 168, 169,170, 171, 172, 173, 174, 175, 176, 177, 178, 179, 180, 181,182, 183, 184, 185, 186, 187, 188, 189, 190, 191, 192: Xaa = Any Amino Acid
  VARIANT 193, 194, 195, 196, 197, 198, 199, 200, 201, 202: Xaa = Any Amino Acid
MSEVYSVPFAKFCTTERVDMVMAIVGRRKLICEECLNEEGHFKHFNSYSQAKVINIYVPWNFRCECPISGWKSPRYLIGTSKSTRAKLNLPLFTCLLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCFTCFACKSAPMPMASICISQTPPSQNPGHCAKLSSPSVPTFNKPQEFALSHPH

SEQ ID NO: 23564 - protein, 291 aa, Homo sapiens
  VARIANT 220: Xaa = Any Amino Acid
MAVASALQFPKKSSHPHRTALHLASANGNSEVVKLLLDRRCQLNILDNKKRTALTKAVQCQEDECALMLLEHGTDPNIPDEYGNTALHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSRHNVICQLLSDYKEKQILKVSSENSNPXEMSQEPEINKGGDRKVEEEMKKHGSTHMGFPENLTNGATADNGDDGLIPPRKSRTPESQQFPDTENEQYHR

SEQ ID NO: 23565 - protein, 212 aa, Homo sapiens
MAVSHAGCAHGILLVILFDQFQDTDLTGDAAGSGLSAHGHSLGATLGPMTVDGVGRHLLEAFSHQCLPLPGARASSTPTPAAWGKLLQEAKVVLAKLRKSRMCGLWAGNGPENNVGAVSMEGRMLATVFTILSPSCTISKLGLMTVPANEVTAQQVEARWHRLEVPEVLSVWLSPFPYPQPHLKQETPGFPRHTNKPREEESDPVPAQGKRI

SEQ ID NO: 23566 - protein, 214 aa, Homo sapiens
MGRRPARCYRYCKNKPYPKSRFCRGVPDAKIRIFDLGRKKAKVDEFPLCGHMVSDEYEQLSSEALEAARICANKYMVKSCGKDGFHIRVRLHPFHVIRINKMLSCAGADRLQTGMRGAFGKPQGTVARVHIGQVIMSIRTKLQNKEHVIEALRRAKFKFPGRQKIHISKKWGFTKFNADEFEDMVAEKRLIPDGCGVKYIPSRGPLDKWRALHS

SEQ ID NO: 23567 - protein, 222 aa, Homo sapiens
MPKVVSRSVVCSDTRDREEYDDGEKPLHVYYCLCGQMVLVLDCQLEKLPMRPRDRSRVIDAAKHAHKFCNTEDEETMYLRRPEGIERQYRKKCAKCGLPLFYQSQPKNAPVTFIVDGAVVKFGQGFGKTNIYTQKQEPPKKVMMTKRTKDMGKFSSVTVSTIDEEEEEIEAREVADSYAQNAKVIEKQLERKGMSKRRLQELAELEAKKAKMKGTLIDNQFK

SEQ ID NO: 23568 - protein, 1222 aa, Homo sapiens
MFDDDESTLGSDVCSLKIRYESFQDNVRDKTTLLMQEDAQFNFFPSVFTTCPKRESKSGALKQSSDFSQFKVPDVSIIWGEEDKNLDKKKGKEEGQEDKGVEKKDGKDNGEKPALNKPCSGTEVEQLKNPKQGHLANSLETSGSFSDDSSFIEISYDAMGEIKDCSRYMARDTNSGSSSSQQNYGLRAKRKVRYSEDYLYDVDSLEGEKVNERKEWLPVGSKEEDDDEWCPKKRRKVTRKEPPVIIKYIIINRFKGEKNMLVKLGKVDASETTVNLSENQLNKYAKLAPLKGFWQKKKKQRNTNTDSIKTPFSQKQSFEPGSFEVSFLPPARKRKSKLGNRHRIQRIPSIEISASSKQISLCNDQRHASNHKEDGGLKGTLKSAPLGAPSCANGSHLNDITGPDSVKVKAQDTEFKGPERKVLNKIKFKSEARLKSKKVKAAGQESKPIVQMSPLLENQSSKANLKNEVIPGTSNSSRLSEFHEAKAAKSSTFLPTTCSSEMPLSSANVTTNIPVIPGGYLQTLLDASDLSNNTSISYFSHHSPEQNEGSLTQTEKSFVPLQPTQDCVLTSSSDSELQQSSHNFKMESSNYRNVWPNKATSGTQEFMAEVSREIAPTQSSEFGASQVVSMENNLTPTTYNPICLNSGGSNCNKVLYDSMQDTQLPSDDSYQLCHFNNGEICFPFQQGPVNMDDGRLFSFDSMAPLSVSSSNYCSLSLKSCEKDGDDDITDDFLAHCSPKLVIQQSIDEIAPLKESTDLLDISNFTPDKFRHSSLSEMSPPDTPSLSPQITRCESMKTLGTLKGFQEGVPGPLDSVEKIKWDCSTLSRQVQMEDGFTLNNHQFQFHMFNDEDSVSLLQKNPCLSTFNDPSGQISTNNKVSKSRKKSSPSKSGAMNQSSSQKNTRKKSLKGNNKGIEKPPGKNSRQVPKSTKKGKYMAAINGEKMQIGIGRGGSQTNTISSTGKTLAECIQHGGPMASMKMPSQKGLSGDWALGKESSPGWSDMSMGTNTNSLLDDDQREFQEPSYILSNIASGMADVQRFMMASIEPLWEPMEHHGDPNIFYSPESNSLKLKTLKILAGTPQESKKKINSGSQGATKNHRSIKGVSKSNGKTAIGDPGRANMPGYNEDSRSTFFDKKYSNMSTLGNNGPTHKKLYRHKSSSKALRDEKCKGKHMEREQVHKDESGTASFEKLRDSDYNLLKAETTFWVLPVFEEETRIFQKDI

SEQ ID NO: 23569 - DNA, 519 bp, Homo sapiens
  misc_feature 126: n = A,T,C or G
ggggccacgctgtgtcagagaatggtgcctcagtggaggaccccatgaacatctccatcatcgtgaccgaccagaatgaccacaagcccaagtttacccaggacaccttccgagggagtgtcttanagggagtcctaccaggtaagaagactgggaaggggactgctacggggctgggcccacacccttaaatgctaaaagatcccaccatacctgatttccttggctgtgtatcagattacttgggatcttcttaaaaatccagatttccccccttccatcccaaggttcctgaataagaatgatcctagagcagagctctggaatctgtatatttgaaattttccctaaagcttcagatgatcagccaagcttgggaaccactagctttggagcttcaaagacctagatttgaatcttggctttgccctctttaccggctgtgatcctgggcatattcttgacctctgagcctcacttctcacatctaaaaatgggaataatatcaactttgaagag

SEQ ID NO: 23570 - DNA, 535 bp, Homo sapiens
gggcagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactccgtcaagaccgcacgcttgccaatccaggaatacatggtcagaaaccagaatgggaaaaactatcattcagagatactggccatcaatcaagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttg

SEQ ID NO: 23571 - DNA, 445 bp, Homo sapiens
gacagaaggggtgtatggtgtggggtgacattttaatctggactccaaatctaaaatgtacatgttcgcttccattaccaggtacgattgatagtgttggtggcctgtctaatcatatagcagctctaaaagagatggtggtgtttccattactttatccagaagtctttgaaaaatttaaaattcaacccccaaggtaatttaattatatttttaattttagctgaaaatctttgctattcttgcttcttgtagttcttataccttgcttattaacccatttttaagtgatagttcccttttcccttttcattatacaacttttctctctgaatcacctttatagaagcagtaattttaataaacttttaaaaattagtaagctttccccccatcataaaagtaatatactgggccaggcacagtggctcatgcctgtaatccc

SEQ ID NO: 23572 - DNA, 619 bp, Homo sapiens
  misc_feature 98, 328: n = A,T,C or G
acagaagggattttaagtgtcctggttaagagaggcatttactgttagctgcatttggtacttaagagaggtaacttgaaatgtcttaagagtcttanaatgcttaatgttttttttcttgcccatatgacagttgaacattttgcatattcgttaatgggattttttggtctgttttggctgctataagataatgctatagactcagtgacttataaacaacagaagtttatttctctcagttctggagggtgggaagtccaaggcactggcaaattcgatgtctggtaagggcctgctttgtggttcataggtggctgtcttctanctttgtccttatgtggtagaaggggtgaaggcgtctctggggtttcttatatgaggtcactaatcccatttgtgatggctctgccctcataacttaatcacctcccaaaggccgcactttcaaataccgtctcgtgggcggagggcgtattgggattttaatacatgaattttaggagatggaaacattttagtccataacatacaatgataatactaatttatgtgatttaataaaagcttattctcttaaatcttggaacaagatttgtattaaattattctcctaatt

SEQ ID NO: 23573 - DNA, 637 bp, Homo sapiens
  misc_feature 59, 547: n = A,T,C or G
gactgcagtagaagcagttgtattacaaggtggaccaatggctccttctgagggtttangatggctgactagaggagagcgggggtggaggtcctctctccggtggatgaacctgcaagatgaaatagccagaagctaggctgggcatggtggcttacgcctgtaatctcagaactttgggaaaccgagatctcgatgggataaccacattggtttgtttagtaaacactgagaccaactccaccatccagaggcctgacagacaaatggcctgagacagggctgggaaagttttgcttctggttgggacttcaggaagagttttgttttgttttgttttcccccaagggaacaagcccttgaatccgggaggccaaggttgcggtgaaccgagattgcgccattgcactccagcctgggcaacaagagcgaaactccgtctcaaaaacataaaaagtaaaaaagatatgtacgtcaatgtcagactttctgtgctggatggaaggactctgagcctaccaaaggaagcgtatttacaaacctctangtactgacttgttgctgaaggtcagaaatttgcaatgacatttggatgtattcaagggtggaggggcaggtttggggaaagttcttttaa

SEQ ID NO: 23574 - DNA, 499 bp, Homo sapiens
tatatgtttgctgctttggaatattaactgttctctagttttcgttattagaatactttatattttttcaacctttatctgaaatttaggcacatttgtaacaacaatgtacttccaagattttccttactggtaaactaataggtaaatttaaatttagtcttcttttcatagttagcattctatcgtatgttgatggaaagtcatttgtatagtgtttaagtttttcagtgttcttgatctttctgagactgtaggtagacagacctcattttcattttacagagaagaatagaaagcctagagtgacttgcttagcttcactatacatagtggcacgggtcttccaagtccatcattctactctatatcctgaatgtggccagaaattttctcacattgttagccttaaaacacagtttcagacctgttggtaacatcactggccaacaaatgcaagagaaaaaaagaaaagttaataataaagtttgctatttta

SEQ ID NO: 23575 - DNA, 557 bp, Homo sapiens
  misc_feature 132: n = A,T,C or G
acagaagggggccacgctgtgtcagagatggtgcctcagtggaggaccccatgaacatctccatcatcgtgaccgaccagaatgaccacaagcccaagtttacccaggacaccttccgagggagtgtcttanagggagtcctaccaggtaagaagactgggaaggggactgctacggggctgggcccacacccttaaatgctaaaagatcccaccatacctgatttccttggctgtgtatcagattacttgggatcttcttaaaaatccagatttccccccttccatcccaaggttcctgaataagaatgatcctagagcagagctctggaatctgtatatttgaaattttccctaaagcttcagatgatcagccaagcttgggaaccactagctttggagcttcaaagacctagatttgaatcttggctttgccctctttaccggctgtgatcctgggcatattcttgacctctgagcctcacttctcacatctaaaaatgggaataatatcaactttgaagagtggtgaagattagaaataccatgtgcagactg

SEQ ID NO: 23576 - DNA, 484 bp, Homo sapiens
  misc_feature 417: n = A,T,C or G
gggcctgccttgggcctgcccgacccagggggtcacatgccttgttcccctcaacccagacaccgactcgcccaagggtcttccagctggctgagttggaacctgcattttttaaccacaaggaaaagaagcccagagctaccaagaataatattttattgacttggaatgagttttggaatctgtatttttaacaagctgcccagtgaaaaccatttcctcctcgtcgtggcgcaggtccagaggctgcgcccatctctcccacgtcaacagtcctgtgtccttggcgaaggactgttctctcattcagtgcctttcctctcttcctgggccaaatccctgctttgcgtctccctgcagctcataaaaagctgaattacctgaggcagggaaagccccacccactgtcattctcanggaggagtggagtctgcagaggccgcaatgcacagcttccctatccccctccacccgtgttttccca

SEQ ID NO: 23577 - DNA, 635 bp, Homo sapiens
  misc_feature 545: n = A,T,C or G
acagaaggggctgactctcttttcggactcagcccgcctgcacccaggtgaaataaatagccatgttgctcacacaaagcctgtttggtggtctcttcacacagatgcacatgaaatttggtgccgtgactcggatcgagggacctcccttgggagatcaatcccctgtcctcctgctatttgttccatgagaaagatccacctacgacctcaggtcctcagaccaaccagcccaagaaacatctcaccaatttcaaatccaatcttcttggcttagcggctgaagactgacactgcccgatcacctcggaagccccctaaaccatcacggatgctgagcttcgggtaactcgcacagtggaagacaggaatgtcaggcctctgagcccaagctaagccatcatatcccctgtgacctgcatgtacacatccggatggccgattcctgccttaattgatgacattccaccacaaaagaagtgaaaatggactgttcctgccttaacggatggcattatcttgtgaaattccttctcctggctcanaagctcccctactgagcaccttgtgacccccactcctgcccgccagaaaacaaccccccttttcctttacctacccaaatcctataaaac

SEQ ID NO: 23578 - DNA, 593 bp, Homo sapiens
  misc_feature 113, 146, 178, 384, 416: n = A,T,C or G
agggggactatgctagggcatggtataggctgaagctcagtgtgataggaaaagctcagggtagggaatggggtgttagagggatagttacagtgagggaagtttcattctanatcagcagtcagcccagtagaacagccacctantgggaggctagtacaactgattgatggctcangagcaggtattgcccaaaatcctgggtatgtggaattggaattgtggagagttgttggtgggtaataagacttcgccccacagttgagatttaggaactatgtactcacttatggcaggaaggctttataagaagggggctatgagagaaaatatttgcaaatcatctgggcgcagtgatgcatgcctgtagtcccagctactcangaggctgagatggcaggatcccttgagcctanagttcgacaccagcctggacaacatagtgggatcacatctctataaatgaaggaatgaatgaaaaccattgaaaaaatatttgtaaatcatatttctgataagggatttatatccagaatatagtactcttacattcaatgataagataaaatttaataaggggcaacgatttgagt

SEQ ID NO: 23579 - DNA, 541 bp, Homo sapiens
  misc_feature 291: n = A,T,C or G
agggagaatgtattgcgtttttctttattctttttgctttgagaaaagagaatgtgatttaagagtaataatttgaataccaattatccacattaaaattgtgtcctctatgtgtaaggcatagcacatttagcacacatacataagcacactaagcaccttacaaatatcctcatttattctttacataatcttttgaaattgattatgtaatacacactgtttttgaacaattggtgacttccagctgtttaaaacaaactacagtatggtgcttgagtactgacttangaggtcagcattggtttcactaggagcttctcaaagcacgctgccaaacatgctccagtctcattgtcaaggccttagaccaggcaatcattacggcagtggttcttcaacttcagcagcagcaaaacgatctggcgggggcttggtgaaacagactgctgggctcgaccaccagaatttctcattcagagggtctggcctgatcacttgcatttctaatcacttcccaggtgatgcagatgtttctggt

SEQ ID NO: 23580 - DNA, 405 bp, Homo sapiens
tgtaaggcatagcacatttagcacacatacataagcacactaagcaccttacaaatatcctcatttattctttacataatcttttgaaattgattatgtaatacacactgtttttgaacaattggtgacttccagctgtttaaaacaaactacagtatggtgcttgagtactgacttaggaggtcagcattggtttcactaggagcttctcaaagcacgctgccaaacatgctccagtctcattgtcaaggccttagaccaggcaatcattacggcagtggttcttcaacttcagcagcagcaaaacgatctggcgggggcttggtgaaacagactgctgggctcgaccaccagaatttctcattcagagggtctggcctgatcacttgcatttctaatcacttc

SEQ ID NO: 23581 - DNA, 518 bp, Homo sapiens
gacagaagggggattgtaaacgcaccaatcagcgccctgtcaaaacagaccactcggctctaccaatcagcaggatgtgggtggggccagaaaagagaatataaaagcaggctgccccagccagcagtggcaacccgctcgggtccctttccacactgtggaagctttgttcttcggctctctgcaataaatcttgctactgctcactctttgggtccacactgcctttatgagctgtaacactcaccgcgaaggtctgcagcttcactcctgaagccagggagaccacgagcccaccgggaggaacaaacaactccagacgcgccgccttaagagctgtaacactcaccgcgaaggtctgcagcttcactcctgagccagcgagaccacgaacccgccagaaggaagaaactccgaacacatctgaacatcagaaggaacaaactccggacacgctgcctttaagaactgtaacactcactgcgagggtccgcggcttcattcttgaagtcagtgag

SEQ ID NO: 23582 - DNA, 590 bp, Homo sapiens
gaactaaagttgatgcagtaattggtggggtagaaatttgaaatgcctctcatgacttttttcctcttagtgagttaagtaaccacctgattagagtggtgggacttagaggaagcaactggagatcctgaaagactccaagcagtagcactgaattgaagataattaagtataagtgccaaaagaaaaggccagagatactgtggtagcagatttttagtgttataattttttgttttaggtgctgttacactaccaaactgtcagtgaacccgccgttattaaacgattgattagtgtcttaaacaaaagcacgggtgaagtcacaaagaaaaagcctaagtgagtgttttaatacagaaatgataaacaagcaatttaagccaattttttaaagattaactcatttgtgtagtatttctctttgtggtaagtgaaacccatttttacttgttccagaaattattttttcaagggctagattaaaacaaacataaaaacaagcaagtatttaagctcttgtttagatatgggtactagataatttctgttatgtgtggtggtggaggatgtgaattataaataaatgt

SEQ ID NO: 23583 - DNA, 274 bp, Homo sapiens
caccatctatatcaaatatagatgattctcttgagtagtaaaagagtacaagcatattcaatgctatttcttaggaaccgttaattaatctttcaacaatcaattcaatcatgattacaacagctttgatgagcactagtgctacagcaactgagacagcaaccaagaggtaagaaacctgggattggttttcatggtgtttctaccatcagagtcaaagaatcatcttcacacaacaacacaaatggctggtaatgagttattattatctcat

SEQ ID NO: 23584 - DNA, 472 bp, Homo sapiens
ctctttgcaataaatcttgctagtgctcactctttgggtccacgctgcttttatgagctgtaacactcaccacaaaggtctgcagcttcactcctgaagccagcgagatcacgagcccaccaggaggaacgaagaactccagacgcgctgccttaagagctgttaacactcaccacgaaggtctgcagcttcactcctgagccagcgagaccacaaacccaccagaaggaagaaactctgaacacatccaaacatcagaaggaacaaactccagacacgccaccttaagagctgtaacactcaccgcaagggtccacggcttcatttttgaagtcagtgacaccaagaacccaccaattccggacacaatacattgaaatattatttatacttagaaaataacatcttggccgggcactgtggctcatgcctataagcccagcacttttggaggccgaggcaggtcgatcac

SEQ ID NO: 23585 - DNA, 376 bp, Homo sapiens
acagagggggtgcagttaaaggaaggtttttcagacttaaagtcattagactctccgcactgaactgaatacctggccttgggcgcttgcacagctttagcccattttcagattcttcttaatcctttggtgaaaactgagacacaaaatggctgcaaataagcccaagggtcagaattctttggctttacacaaagtcatcatggtgggcagtggtggcgtgggcaagtcaactctgactctacagttcatgtacgatgagtttgtggaggactatgagtctaccaaagcagacagctatcggaagaaggtactgctagatggggaggaagaccacatcgatatcttaaatacagctgggcaggaggactacgct

SEQ ID NO: 23586 - DNA, 329 bp, Homo sapiens
caacgttgacagtaatgaacaaggctcctatgtagtggccatggaaacctttaccaacttaggacccattgtcgatatgtgcgtggtggacctggagaggcaggggcaggggcaggtaagggccattctgaaagtggatagttggtatatgcccactcaaactgtgtcctcctagctatgcttatctagaatggggagggtgcactgaaaatacttttaagagccccctcatgaatcccagtgatataaggataactactgtttattgagtgcctatcttggtctgccaggcactttatatatattatctctaattacacaagtaccct

SEQ ID NO: 23587 - DNA, 385 bp, Homo sapiens
gtcagtaataggttcaacatcatcatcactgtcttcctcttcttcatcagcaacaggttcttttgattcttctaaaaaataaaatacccttttaatgtcattatttgactttaaaaaaatgaagcatattgaaaatctgaatattgcaattcaattttaatttccaattatggttgacaaatttatttccaattattgttgaaaaattctgattatccagtgagcattctagaaaagccttgcctcgatctcctgacctcgagatccacccaccttggcctcccaaagtgctccctccgcgcctcaccgggaatgaatttttaaggttgtttttaaggtaatctaatctcatcaacaatgagctaagggtcaacttttttttctg

SEQ ID NO: 23588 - DNA, 562 bp, Homo sapiens
ggcacactcaggaaaagatgtcttttgtgttttcctgaaaccttgcctgagagctctttattttctgtggaagcgaatagcagtaatagccagaaaaatgagaaagctctgacaaatatccaaaactgtatggcagaaaagagagaaacagtgttgatagagactcagctgaaagcatgtgcctcttttatacgaaccaggcttctgcttcagtttacccaacctcagcaaacatcgtttgctttggagaggaacttaaggactcagcaggaaattgaagataaaatgaaagggttcagcttcaaagaagacactttgctgttgatagctgagcagggccaaatttaatctactgaaggacttgtctccctcctctgtgtgccttttgatcactcagcaatcaccaaggcggcctcttgatcggcattcccctgcagcgtgcgggaccgcaggggctgtgtttcatgtacttgtcagtgcttgttagcacctgcctgcctgaacatcatcaatgcccaataattgtttgtttcagtgctgaataaatgaatgaatgaatgct

SEQ ID NO: 23589 - DNA, 556 bp, Homo sapiens
gatgaaaggttttactgagaaggggaaaaccttagatagagggacatgtgagacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaa

SEQ ID NO: 23590 - DNA, 476 bp, Homo sapiens
gggaaagtctgtgtttgtaacacaatcttatgacatcagcattaaaaaggctattcagaacacttcctcaaattgaaactattaccaatactgagttaaatattttaggactacttcattatctaggaaatttgagaagcaaattaactctttgctcagagtattgtgataccatatcttttcttgtaaaataagatattgtttaattataaaatattgtcaaatttctgaaaaagtgtttatataagtgttaggaatatgttagccctgggagccatgtgttactcatcattgtacagatcttcttgctgacacaactgggtatggtagacggcctgatatgattaactgcaagtaaagcagaaattattaaaaacaatattgaggccaggcaaggtggctcatgcctgtagttccagcactttgggaggtcgaggcaggtggatcacgaggtcaggcattcaagactagcctga

SEQ ID NO: 23591 - DNA, 546 bp, Homo sapiens
acagaaggggactggcagcaacccagcgcttccattgctgacctctaccgacctctacctgtggtccttcctctactgcagcagagacactgttttcttcctttgttcttccaaccccatggggaatatcacagaagtgaagtgcaattctcatcatgtcatatcaagagcacacactaacaaacaacatgacttattgctgaatattgaacttgatcacctggctgaggtagtgtttgccagatttctctgtaaaggtgaataaactgacactggaacattcaggaacttcttcatggtcatggtcacccagctagagtgtggaagccaggctgtctgattccaggatctgtgttcttaatcctatacataaggaagccataatgagtcaaccactatttttaagattcacagatgttcgggtccaattcaccagaatgccaagttatacagggttgtggaatcaaaaactgcaattagtaataaaatgtgatgctatctagaatgtttttcatacatatatatgcttcttgggactctccctgc

SEQ ID NO: 23592 - DNA, 610 bp, Homo sapiens
gctccttgggaagctaaggtgggaggatcgcttgagcccccaggtggtcaaggctgcagtgagcggtgatcatgccactgtactccagcctggacaacagagtgagacactgtctcaaaaaaaaggagtctatctcagagttcaacgaatggataattctagtgtggacaactctggtgtaaacatgactgaaaataattcacaaatagtctgttacagctccatccactgaaaattgtcataaaagacatttttcaaatgagttcatttttagaaaaaccattccagatatcttaccttcggaaatcatccaaggagtgtgataaacattacaacccccataaactgggtaaacaacaacaatggagtgaaaaacgaccacacatgccataaagcaatgttgaagctgaaaagaacaagacataaacagttgacaactcaaacatgcatcaatatattttattctagaatccagatttaaagtattcaatgtagaaaagttcatccagtcagcaaccttctccatgtatcatatttctcagctatgtgacttagccaatgctggaaagaaaactctagatatacttacacaagtatcacaatttcttca

SEQ ID NO: 23593 - DNA, 636 bp, Homo sapiens
  misc_feature 358, 410, 435, 485, 492: n = A,T,C or G
ggaggaagcggaagactaatgaccgaagcttcaagactttgacatgtgtgaaaacatgaaatgacccttggctcttattgttcttgctggtgtggtgtgttcacggctgaaaagatggtcagaaggggaaaggaggaagtgagaagaaagaaacagggaaatgacagagtgttgctcagttacccaggctggagtgcaatggcatgatcttggctcactgcagcctccacctcctgggttcaagcggttctcgtgcctcagtctcccaagtagctgggattacaggctggagtgcgatggcatgatcttggctcacggcaaactccgcctccctggttcaagtattctcctgcctcancctcccgagtagccgggattacaggcatgtgccaccatgccccgttggccangctggtctcgaacaccttacctcangtgatcctcccacctttgggattacagcaggctgaggaattaccaaggangcaggangtggagcaaaacacaccaagcctggtgccaatcattgacaatattatggaactgactcagcgcaagaagacagcttcgactccttgtgatttcatccctaaccaatcagcactcctggctcactggcttcccccacccaccaaa

SEQ ID NO: 23594 - DNA, 606 bp, Homo sapiens
ccatggcgcaggggcagcgcaagtttcaggcgcacaaacccgcaaagagtaagacggcagcggcagcctctgaaaagaatcggggcccaagaaaagcggtcgtgttatcgctcccaagaaggcgcgcgtcgtgcagcagcaaaagctcaagaagtagagacggggtttcaccgtgttcgccaggatggtctcgatctcctgacctcgtgatctgcccgcctcagcctcccaaagtgctgggattacaggcgtgagccaccacgcccggcaggataacatcttaacatacatcccggagttgtctttcagaggcttggaaccccactgaggacccccgctgaacagatccattcactggcacagactcctagataaggaagaagtgaagactaaacttgacctttgttctgtttcttccttgggggattagagaaagtcactccctgtaaccagttatttttctactgacccctgtcaggcctctgagcccaagcctgcacgaatacatccagatggcctgaagcaagtgaagaatcacaaaagaagtgaaaatagctggttcctgccttaactgacattaccttgtgaaattccttttcttggctc

SEQ ID NO: 23595 - DNA, 441 bp, Homo sapiens
gcgggaattggagactgtagtgtgctgccatcatgcctgtgtatagcttctgcgctacagcctgggcaacgtagcgagaaccatctcagaaaaaaaaaaaaaaaaagaaaatattcttttcctcataaattcactaaaactggaaatatttgaccggacttggcaccttttggggggaaggacgaaaaaaatatttttaaactgcctaccttattttaataataaaaattggttaaaccagctggcctattttcttttttttctggaaaattattttccactgagttaaattttttgaaaaagttacacagaattctttggccattctttatatctccctttttgaagttatgtcccttaatttctgaaactttctgaaaccagggttaatttgttttaaaattgcccaacgggggctttaaaaaaaaaaagggatgtttt

SEQ ID NO: 23596 - DNA, 622 bp, Homo sapiens
acagaagggggccttatatctatatcactggaacccctttccttcctttttctacttaaaattggtttcatccatgacatcttcatttgacaccatatcgtttgactgtttctggaatattaccttttctgccattgtttatatactctaagactttgaaatgacaatttattaagcaatggtataaaaaacctgagcgtagtggttgcattttttgagcaagatggagatgttaatacttttctaaaaagttgtttttctcaattcctccacttccttaaatccctgatttcaagtttctattgcatcattttaacagccttttcagttcctccacattagctgctgaagtaggaaaccttaaacaagagattccttagctgtgttctacaataatagccaaattccaaccctatgatttattatcttcaaaggctgtaatctactaaatttcagagatctgataaaattacattaatatatacaaatacatgcatatgcatatataaaaggaagaatattgaatcattctgtggttgcaataaaatttaaatcttttaagattcacattttatatttgaatagtgcttttggaaatcaccaattttactggatatttgga

SEQ ID NO: 23597 - DNA, 563 bp, Homo sapiens
gggataattttattttttagaacaaaattaaaaataaagtgtctttaaatgaaagtctgtgtttgtaacacaatcttatgacatcagcattaaaaaggctattcagaacacttcctcaaattgaaactattaccaatactgagttaaatattttaggactacttcattatctaggaaatttgagaagcaaattaactctttgctcagagtattgtgataccatatcttttcttgtaaaataagatattgtttaattataaaatattgtcaaatttctgaaaaagtgtttatataagtgttaggaatatgttagctctgggagccatgtgttacttatcattgtacagatcttcttgctgacacaactgggtatggtagacggcctgatatgattaactgcaagtaaagcagaaattattaaaaacaatattgaggccaggcaaggtggctcatgcctgtagttccagcactttgggaggtcgaggcaggtggatcacgaagtcaggcattcaagactagcctgaccaagacggtgaaaccccgtctttactaaaaatacaaaa

SEQ ID NO: 23598 - DNA, 497 bp, Homo sapiens
ctgccatccccactaagcagtcatgtgaccttggaaaaactccctactctgagtctcagtttctttatctgtattaggtttcaacaaagggaataaatcattggcttctcatgaggttgtcataaggattaaataagacaatgcatataaaagaactggcagacaataaatatagagtcccccactcctgcttggtgctctctttctctctccttctctacatagagaagtgccagagcatccgtcagtagaagttacttaaggttggctgtgtcttccacatcttttgtttacccatgaagaactgtgaccatcttgttctgtgtcttgtcataaagatgggacgtgacttctttctgctcttgcttccatctggtgctgttttctgcacagcctccttgagaccttccagaaccttcttttttcctacttcatatcacttaaccagtagctatctgggatggttccagaagctgaagtttgcagttgaataacat

SEQ ID NO: 23599 - DNA, 501 bp, Homo sapiens
caatattaaaacacactatgaagcctctgatacttaaacagcatggcgctggtacgtaaatagaccaatgcagttaggtggctctttccaagactctggggaaaaaagtagtaaaaagctaaatgcaatcaatcagcaattgaaagctaagtgagagagccagagggcctccttggtggtaaaagaaggttgcatttcttgcagccagaaggcagagaaagtgaagaccaagtccagaactgaatcctaagaaatgcaggactgcaaagaaattggtgtgtgtgtgtgtgtgtgtgtgtgtgtgtgtgtgtgtgtgtgtttaatttttaaaaagtttttattgagatacaagtcaataccataaagctctcacccttctaaagtgtacaattcaggggtgtgagtatattcataagatatatacttggtgtgtattcataagacttatatccagcatattcataactagagccatatcacagatgcattcatcataataat

SEQ ID NO: 23600 - DNA, 662 bp, Homo sapiens
  misc_feature 458: n = A,T,C or G
gacagaaggctgggacttcaggcgtacgccaccacgcctggctaattttttgtatttttagtagagatggggtttcaccgtgttagccaggatggtctcgatctcctgacctcgtgatccgcctgcctcggcctcctaaagtgctgggatcacaggtgtgagccaccgtgcccagcagaaatgttcttaagtcacaaaacatttaataaaaatttaaagaaattgaacattgacaaaagatgcaaaataaaaaagacacatactggaagcaaatatttgtaatataattgaccaggaaatagtatctctagtgcctaaagagctcctgtaggctgtggagcagccatccttttattcctttactttcttaataaacttgctttcattttgcactgtggactcgccctgacttctttcttgcacgaaatacaggaaccctctcttggggtctggatcangacctcgttcctgtaacatatttctggcgaccatagaagggactatactgcagaaacccctgacccaaaggctaactttgggtaagtggtggggtctagtaacatctttctcatgaaccacaaaaggggcaatattgagacccccgacccaaaggaaatagatgcagcactgattggacaactttgggtaagtagtggggtacc

SEQ ID NO: 23601 - DNA, 524 bp, Homo sapiens
gtaaatagaccaatgcagttaggtggctctttccaagactctggggaaaaaagtagtaaaaagctaaatgcaatcaatcagcaattgaaagctaagtgagagagccagagggcctccttggtggtaaaagagggttgcatttcttgcagccagaaggcagagaaagtgaagaccaagtccagaactgaatcctaagaaatgcgggactgcaaagaaattggtgtgtgtgtgtgtgtgtgtgtgtgtgtgtgtgtgtgtgtgtgtttaatttttaaaaagtttttattgatatacaagtcaataccataaagctctcacccttctaaagtgtacaatacaggggtgtgagtatattcataagatatatacttggtgtctattcataagacttatatccagcatatacataactagagccatatcacagatgcattcatcataataattccacacattttcatcaccctaaaaagaaaccctgaaacccattagcagtcattccccattcctccaacccattatct

SEQ ID NO: 23602 - DNA, 613 bp, Homo sapiens
  misc_feature 71, 545: n = A,T,C or G
ggggtattcatgatgagacagttaagacacagcaaattaagtgaccagtgctatttgtttgaagaacttantttattcttctgtgtacttattttccacatctgcagaactgtgaccatcctccacataatttatagtccataccaagtagtggatcaaacgagctcctgccaggcagtcaccagcttctgatgagaacagcagcatgcagcctgcacttcaatgctgcactcccaagaccagctgcggcccccacactgccagtgctgtgtgtaacgggtgctctgtagttcagtattattgatttcctatagattctttattttttaaatagcccatgtcagtttctttcttttaagtgtgggaagggtcctaagctttagtttcctgttctgtaaagagggatgatactctttgccttgtttatctaccatgcaattattatgatcaagtgagattatttttgtgaagccatgtaaactataaagtgctttccaagcatgaggaattactgtggatgatcttgagtttcacatggaggtcangagcagttaaaattgttggttgtgataccatccataatctcttctctcaacaccctctgcaagctcta

SEQ ID NO: 23603 - DNA, 602 bp, Homo sapiens
ggggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaagagacggggtttcgccgtgttcgccaggatggtctcgatctcctgacctcgtgatctgcccgcctcagcctcccaaggtgctgggattacaggcgtgagccaccacgcccggcaggataacatcttaacatacatcccggagttgtctttcagaggcttggaaccccactgaggacccccgctgaacagatccattcactggcacagactcctagataaggaagaagtgaagactaaacttgacctttgttctgtttcttccttgggggattagagaaagtcactccctgtaaccagttatttttctactgacccctgtcaggcctctgagcccaagcctgcacgaatacatccagatggcctgaagcaagtgaagaatcacaaaagaagtgaaaatagctggttcctgccttaactgacattaccttgtgaaattccttttc

SEQ ID NO: 23604 - DNA, 497 bp, Homo sapiens
  misc_feature 166: n = A,T,C or G
gggttgcctgtgggtgcccgcgaaccaacggttagcggtggcaggggctgactgagagcgtctgcttgacagagtctttctctgtcacccaggctggagtacagtggcacgatctcggctccctgcaacgtccgcctcccgagttcaagtgattctcctgcctcanccacccgagtagctgggtctacaggtgtgcgccaccatgcctggctaatttttgtatttttaagagagacggggtttcaccatgctggccaggctggtctcgaactcctgacctcgtgatccgcctgcctcagcccctcaaagtgctaggattagagataatggattctgaattaatgcatagtatagtaggaagctatcataaacctccagaaagagtatttcttccctcattcacccagaatgaaccatctcagaattgccatcctgcaaacttagaagttacctctcctaagatacttcatagcccaaatagccaagctcttatttta

SEQ ID NO: 23605 - DNA, 644 bp, Homo sapiens
attcatcaagtcagataaagggtttaaaccagtcagagaaactaggtggaatggaaaagtactgagagataattggggacagaaaaataaaagagatgggaaatgctgcatcaaaatactcctacctctaggatgttactatatattgttaggagaattcaagttattgaaacttgccaaattcttgagtgaagaggaattcatttgagagccaaaatttgactaaggaaagaagaccaacatgggctttccaaagttgagtttgaattcttccatccccactaagcagtcatgtgaccttggaaaaactccctactctgagtctcagtttctttatctgtattaggtttcaacaaagggaataaatcattggcttctcatgaggttgtcataaggattaaataagacaatgcatataaaagaactggcagacaataaatatagagtcccccactcctgcttggtgctctctttctctctccttctctacatagagaagtgccagagcatccgtcagtagaagttacttaaggttggctgtgtcttccacatcttttgtttacccatgaagaactgtgaccatcttgttctgtgtcttgtcataaagatgggacgtgacttctttctgctcttgcttccatctg

SEQ ID NO: 23606 - DNA, 624 bp, Homo sapiens
  misc_feature 406: n = A,T,C or G
ggggcaacctgctcaggtccccttccacactgtggaagctttgttctttcactctttgcaataaatgttgctgctgctcactctttgggtccacactgcttttatgagctgtaacactcaccgcgaaagtctgcagcttcactcctgagccagcgagaccacgaacccaccagaaggaacaaactccgaacacatccgaacatcagaaggaacaaactccagacgcgccaccttaagagctgtaacactcaccgcgagggtccgtggcttcattcttgaagtcagcgagaccaagaacccaccaattctggacacacttttaagagtttaggattctacattaatctgttcagtctatctatattatttcaggtgtctattacatgcctggcaacctcttccctangagtgagtcatctgtcttctaacactcaaaacaggattcttttaagtcatacttatttataataaatggaaacattagttttcatttctaacccacttttcactaacttaactgaataaaatatccttgatactaccttttttcttttgtcaggcaatatattattcagagacctggtgaatggttagaaaagaaagtaagttctacaaagtataaag

SEQ ID NO: 23607 - DNA, 426 bp, Homo sapiens
  misc_feature 258: n = A,T,C or G
ggtaattgcagtcttcgccattaaaagtaatgtcaaagactgcagttacttttgcaccaacctaatatgatagactaaactataaacatacaaggaagaatgatctgtaggaagtttaatacataagaattgggatctggctggatgtgttgggtcagggctgagttcagagtgaacagtgatactaaggtttctgcctttatctattcttgagaaaaatggatgatgtttcgggtttttaaaaaagtttcactttanagcagttgagattgagtgtttttagaacatctggctattgagatccagtaagacttgaagaataaaggtttggggtttatgaaagaattctagggccaataatacagatttaggaatcatggtggcattttatggcatgagagttgatgtgatcacaaagggaaacta

SEQ ID NO: 23608 - DNA, 580 bp, Homo sapiens
acagaagggatgggtctcactatgttgcccaggctggtcttgacctcctgacctctgctgattccccccacctctgcctcccaagtagcgggattacaggtgtgagccactgtgtctgacaagaatttatacttaagcataggagatggttctggaaattctaagaaattctgctctcagtaagagtagaggtttggagctttacctcttggcagtatcccttggaagggagctctgagaaaatgtaatcaaacacttattgagagctttctatggaccaggcactacactagacgctgggaattacagaggcaattacctgtcctatactcaaggtgttaatgatctagtgtcatttttctttaaaaaagaaagcacctgcatttgtcatcttgagcaaatatagtaactctaacctcaaggttcaagtgatttactcaaggtttaaatcatagttgttttggagaaagtaagtgtcagatgcactgtggctgtcagggtcatagtaggcattaaatcaacatggttggtgttcattaaatgtggattgaagataaaatgactgatcttaagtttcatg

SEQ ID NO: 23609 - DNA, 473 bp, Homo sapiens
gggaattggagactgtagtgcgctgccatcatgcctgtgtatagcttctgcgctacagcctgggcaacgtagcgagaaccatctcagaaaaaaaaaaaaaaaaaagagatattctattcctcataaattcactaaaactggaaatatttgaccggaacttggcagcttttggggggaaggacgtaaaaatttttttttaacggcctaccttattttaataatcataattttttaagcaagctggcctattttcttttttttctggaaaattattttccactgagttaaattttttgaaaaagttacacagaattctttgggcattttttatatctccttttttgaagttatgtcccttaatttctgaaactttctgaaaccagggttaattggttttaaaattgtccaacgggggctttgaaaaaaaaaagggatgttttttgggtcaaatgaaggtaatcataaataaaatt

SEQ ID NO: 23610 - DNA, 352 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggacaggattgacagattgatagctctttctcgattccgtgggtggtggtgcatggccgttcttagttggtggagcgayttgtctggttaattccgataacgaacgagcctctggaaaaaaaaaaaaaaaaaaammc

SEQ ID NO: 23611 - DNA, 439 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggtagamgrytcaagggcsagatctwgatgcccracattggttatggaagsramaaaaaaaaaaaaaaaaaaaacccccttggggccgttttttccgtaaacccaaccttgaaaaa

SEQ ID NO: 23612 - DNA, 529 bp, Homo sapiens
  misc_feature 25: n = A,T,C or G
gacgacagaagggtacggctgcganaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggccgcgagaagacgacagaaggggacagcacctgcctgtattcagcatgaccacttgctccagcccctacactgaagcattaaggtcaaagtactgaacagttgttggtccctccacactttgtttttccagcttcgtcataatgtgaatattaatgtttaaaaaaaaacctttattatattgtatttacaacactaggttacataactatagactactcttgccattaaaaaaaaaatctataatgttttcaaaaaatgacttcagca

SEQ ID NO: 23613 - DNA, 824 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggwrcsrcyryrakmmsaygrmattaggtcttgttaaaatctagtccgggcgcagtggctcacgcctgtaatcccagcactttgggaggccaaggcggactgatcacgaggtcaaagatcgagaccatcctggccaacatggtgaaaccctgtctctactaaaaatacaaaaattagctgggtgtggtggtgcatgcctgtagtcccagctacttgggaggctgaggtaggagaattgcttgaacctgggaggcggaggttgcggtgagctgaaatcacgccactacactccagcctggtgacagagcaagactccatctcaaaaaaaaaatctaagcaaactatctttgagtcaaaaaaagttggataactcatctatatttgaaataatgct

SEQ ID NO: 23614 - DNA, 691 bp, Homo sapiens
acagaagggaaggcgggaatgaaatgtcctatgttttattaaattcatactgcattttgagagtatggtayakwwgggggccttatatctatatcactggaacccctttccttcctttttctacttaaaattggtttcatccatgacatcttcatttgacaccatattgtttgactgtttctggaatattaccttttctgccattgtttatatactctaagactttgaaatgacaatttattaagcaatggtataaaaaacctgagcgtagtggttgcattttttgagcaagatggagatgttaatacttttctaaaaagttgtttttctcaattcctccacttccttaaatccctgatttcaagtttctattgcatcattttaacagccttttcagttcctccacattagctgctgaagtaggaaaccttaaacaagagattccttagctgtgttctacaataatagccaaattccaaccctatgatttattatcttcaaaggctgtaatctactaaatttcagagatctgataaaattacattaatatatacaaatacatgcatatgcatatataaaaggaagaatattgaatcattctgtggttgcaataaaatttaaatcttttaagattcacattktatatttgaatagtgcttttggaaatcaccaattttactggatatttgga

SEQ ID NO: 23615 - DNA, 576 bp, Homo sapiens
gacagaggggaaggaaaccgcggcgctggggatggagagggggaaagtgaagaagaaagagaaggaaaaggagacgcagaaggagaaaatcggagaaaagggtagggaagagaaagtgaaaagaaaggaggtggagcagaaaattaaacaaaagcaagakaagcaggagaggagaaagggaaaagagaaagaggaaaagaggacaaagcaagggaaggagacaaacaaagagaaggaacaatttaagggacaagaagagaaaggggagaacaaggacagcaccttgacaaggaccccgctcgagccgctggagaaaaacaagcaaatcctartgctgggcctggatggagcaggaaaaaccagtgtcctgcactctctagcttcaaacagagtccagcacagtgtggcacccacccaaggtttccatgcagtttgcatcaacactgaagacagccagatggagttcctggagagatcttgaagcagcctatcacattacagatatccatgaagctttggcattatctgaagtgggaaatgacaggaagatgttcttgtttggaacctacctgacta

SEQ ID NO: 23616 - DNA, 547 bp, Homo sapiens
  misc_feature 459: n = A,T,C or G
tacggcgcgagaagaccacagaagggtaccggtgcgaaaagaccacagaagggtacggctgcgaaaagaccacagaagggtacggctgcgagaagacgacagaagggtacggctgcgagaaracgacagaarggkacggstgcgagaaracgacagaarggtacggctgcgagaaracgacagaagggtacggctgcgagaagacgacagaarggtacggctgcgagaagacgacagaarggtacggctgcgagaagacgacagaagggtacggctgcgagaagacgacagaagggtacggctgcgagaagacgacagaagggtacggctgcgagaagacgacagaaggrtacggctgcgagaagacgacagaaggggawasggytkcrccatgttggttaggctggtctggaactcctgaccttgtgatctgcctgcctcggcctcccaaagtgctgngattacacgcgtgagccactgtgcccagccgatctgatgcttttataaagggctttccccgtcccccttcctctctctcaccaccctg

SEQ ID NO: 23617 - DNA, 399 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggkamkgcwrckagccctgaaaatggatggcgcttaagtgtgctacctaaacttgaccgaaaaaaaaaaaaaaaaaaaaacccctgggggccgttttttccgta

SEQ ID NO: 23618 - DNA, 440 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaarggtacggctgcgagaagacgacagaarggtacggctgcgagaagacgacagaagggtacggctgcgagaagacgacagaaaggtacggctgcgagaagacgacagaarggtacggctgcgagaagacgacagaagggatcccccccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23619 - DNA, 470 bp, Homo sapiens
agaagggtacggctgcgagaagacgacagaagggtacggctgcgagaagacgacagaagggtacggctgcgagaagacgacagaagggtacggctgcgagaagacgacagaagggtacggcgcgagaagacgacagaaagcctacggctgcgagaagacgacagaagggtacggctgcgagaagacgacagaaggrtacggctgcgakaagacgacagaagggtacggctgcgagaagacgacagaagggtacggctgcgagaagacgacagaagggtacggctgcgagaagacgacagaagggtacggctgcgakaagacgacagaagggtacggctgcgagaagacgacagaagggtacggctgcgagaagacgacagaaggrtacggctgcgagaagacgacagaaggggkrckgmwkykrgaasmcgwsrgcmakrgtwygscaacccttgatctagatgaaaaaa

SEQ ID NO: 23620 - DNA, 529 bp, Homo sapiens
cgacagaagggtacggctgcgagaagacgacagaagggttctgttgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggwamgrmwrcggttagtcttttcaggaaaaagcaaacttcttgaacttccaaccctcaatatgcaaatccactgttttctaccttccaaaaaaaaaaaaaaaaaaaaaaaaaa

SEQ ID NO: 23621 - DNA, 534 bp, Homo sapiens
tacggctgcgagaagacgacagaagggtacggctgcgagaagacgacagaagggtayggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggatccamggmwgssagcaggcgcgcaaattacccactcccgacccggggaggtagtgacaaaaaaaaaaaaaaaaaaaacccctgggggccgttttttccgta

SEQ ID NO: 23622 - DNA, 355 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacrgaagggtacggctgcgaggacgacagaaggggaacttaaaataaaaaagaagtgaaagataatgagatgggaaaaaaaaaaaaaaaaaaaa

SEQ ID NO: 23623 - DNA, 552 bp, Homo sapiens
tacggctgcgagaagacgacagaagggtacggctgcgaaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagmcgrcmgargggkmsggckscgasagctttggtgactctagataacctcgggccgatcgcacgccccccgtggcggcgacgacccattcgaacgtctgccctatcaactttcgatggtagtcgccgcgcctac

SEQ ID NO: 23624 - DNA, 289 bp, Homo sapiens
agacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggatrcrgykgmggagatagaaggccggttgcaagggagtgaagagttattaggcagtggggaagtgaaccaaaggctgggaaaaaaa

SEQ ID NO: 23625 - DNA, 757 bp, Homo sapiens
  misc_feature 683: n = A,T,C or G
acagaagggctaagaactttgcacataatcatacaatcttttgaaaatattttgcaaatatgtgtttagacaataagatggactagagttcgacaaaatgatttctttatttaaattttgtataagtattwymkdagagactttcaaattatattgtgttcttgatatatgctgtatatttatttgttagtgcatgtgtttttaatttacatgaaaacatgagttaggagaaattacaggttgaaagatgaaatgcctgtatgtgctctgaagaaatggtaattccagattgtgcagggggaaacaaatctattttgttttgttttgttttttgagacggagtcttgccctgtggctgggctggagtgcaatggcgcgatcttggctcactgcaacctccgcctcccgggttcaggggattctcctgcctcagcctcctgagtagctgggactacaagcatgcaccaccacgcccagctaatttttgtagttttagtagagatggggtttcaccatgttggccagatgatctgaatctcttgacctcgtgatccgcccaccttggcctccacaagtgctgggattacaggtgtgagccaccacacccggcctatattgttttgaaagcatactctatatatagttacgggcagaggcacaggcatcctcagcagctgattcangagatgatggtaaagctagctaactatgaattaaacattcacatatccagtctacctggtccagtaataataca

SEQ ID NO: 23626 - DNA, 502 bp, Homo sapiens
agacgacagaagggtacggctgcgagaagacgacagaagggttctgctgcgagaagacgacagaagggtacggctgcgagaagacgacagaagggtacggctgcgagaagacgacagaagggtacggctgcgagaagacgacagaagggatacatataaatcaattatgaaatgttagtataattgtttacatgtaaatgggcattaggagttgtttattgaaaaaacaaaagatctgagttcagtgttcactattagcactgtgtagacttctgattttaatattgaatctcctagatttgcggttttctgttatcccttgcttatatttattttgatgatcctgtggatttgagagagtgaaaaatagtaattcacacaattctttaattacatgttgatatctttaatagagatgtcactaaagatcagaaaatgaccctttaaccctgttgaaaatgaaatgaggccgggagcagtggctcacgcctttaatcccagc

SEQ ID NO: 23627 - DNA, 667 bp, Homo sapiens
acagaagggatggttcaaacaaaaaagctgacaggccattttggatctgcctcactggattcacaacagacagtcccctttatgaagagtgtgtgaggatgaatgatggattttctagttacctgttagacakrrcagaagaagactgctttagtttatttcccttggaaacccttgtgtacctgactcctgactcagaacacgctcttgaagatgttgatctaracaaagtttacatcctcggtgggcttgtggatgaaagcattcagaagaaggtgacatttcaaaaggcccgggaatactcygtcaagaccgcacgcttgccaatccaggaatacatggtcagaaaccagaatgggaaaaactatcattcagagatactggccatcaatcaagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttg

SEQ ID NO: 23628 - DNA, 369 bp, Homo sapiens
  misc_feature 256: n = A,T,C or G
tacggctgcgagaagacgacagaagggtacggctgcgagaagacgacagaagggtacggctgcgagaagacgacagamgggtacggctgcgagaagacgacagaagggtacggctgcgagaagacgacagaagggtacggctgcgagaagacgacagamgggtacggctrcgagaagacgacagaagggyacggctgcgagaagacgacagaagggtacggctgcgagaagacgacagaagggggcggtggctcangctcctggaaaggaccgtccacccctccgcgctggcggtgtggacgcggaactcagcggagaaacgcgattgaaaaaaaaaaaaaaaaaaaaaaacccctgggggccgttttt

SEQ ID NO: 23629 - DNA, 586 bp, Homo sapiens
gagggggactttcagtggatctatgctcagagtcatggagaaataagagatcctaagatgttttaaactactataatgatctagagttatatgtttgctgctttggaatattaactgttctctagttttcgttattagaatactttatattttttcaacctttatctgaaatttaggcacatttgtaacaacaatgtacttccaagattttccttactggtaaactaataggtaaatttaaatttagtcttcttttcatagttagcattctatcgtatgttgatggaaagtcatttgtatagtgtttaagtttttcagtgttcttgatctttctgagactgtaggtagacagacctcattttcattttacagagaagaatagaaagcctagagtgacttgcttagcttcactatacatagtggcaygggtcttccaagtccatcattctactctatatcctgaatgtggccagaaattttctcacattgttagccttaaaacacagtttcagacctgttggtaacatcactggccaacaaatgcaagagaaaaaaagaaaagttaataataaagtttgctatttta

SEQ ID NO: 23630 - DNA, 806 bp, Homo sapiens
  misc_feature 760: n = A,T,C or G
gaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatmcwkmaksggtaggcaacaaacgcccttttcctgggaaggggagtcattgtcttcttccatatcaagccagcctccagaacatggagacaagtgacggttgccccaagaccaaaagcatttctaaaccagaaaaagggaaagtgccacattttcaaggcgagaagacataatgaggccaggaaaaaggttttcttcctaagaaaacactatctatgttgcagttaagcccaaagcattcatggtgtatgatgaaagaattaaataatgcctgtgctttggagacagcggaaagggtagcaagggtgtgctgaaggctgagaatttgggaatgctgggggagagaaaaatagaagagcactcaaagtgagtctgttcctacattcacattgtcttggagagacaggtttgcatagttgtttacagaggcaggctctgagaggggtgagcctgggtttcagtcttagttctcttgatcttgggaaagtcacttaacctcccaactagtctcctcatgtataaagcggagactgtaatattacttatgtcctaggatggctgtgagaattacaggagatagataaagagcacttagcccactgcctggcanaagcaagcattcaataattatcagatatcactagtaattaataatc

SEQ ID NO: 23631 - DNA, 564 bp, Homo sapiens
cgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggggtcagcgccttgccttctcttaggctttgaagcatttttgtctgtgctccctgatcttcaggtcaccaccatgaagttcttagcagtcctggtactcttgggagtttccatctttctggtctctgcccagaatccgacaacagctgctccagctgacacgtatccagctactggtcctgctgatgatgaagcccctgatgctgaaaccactgctgctgcaaccactgcgaccactgctgctcctaccactgcaaccaccgctgcttctaccactgctcgtaaagacattccagttttacccaaatgggttggggatctcccgaatggtagagtgtgtccctgagatggaatcagcttgagtcttctgcaattggtcacaactattcatgc

SEQ ID NO: 23632 - DNA, 978 bp, Homo sapiens
  misc_feature 867: n = A,T,C or G
agggggtcactgatctggacgcccccaactcaccagcgtggcgtgccacctaccttatcatgggcggtgacgacggggaccattttaccatcaccacccaccctgagagcaaccagggcatcctgacaaccaggaaggtgagtcagttcgggcctcaaacaatggctatacctggggcagtcaggtctgcagccttcaggatgaggagccactgtctaccgtgggctagtccaggaatcgtaccagcccagtggctcccaacactgttctaccactcttgtgtkgggaagtccctttgttcaaactaaatcttacccaggagcccacttcataaataggtaagagtcactgattaattgaascacatcagtggagcctcctcccagaccacagtgtccaatggctgccccgaatcagtctcacatagagagtccatcttattgaaatccatgttgactttgcatttactctaaaactcatgtctaggtgtttagataataaaatgttttgaatcactgaggcacactcttgcctctcaaaaagtctcttttttgtgtgtatgtatttttgtttttattggggtataggacgtgggttgggtcaaaaagtctgaataaggctgggcgcagtggctcacacttattcccagcactttaggaggctgaggtgggaggatcrcttgaggccaggagtttcagatgagcctggtgaacatagcaagatcccatcagcactaaaaaagaaaaaaatgaagatgggcctaatcttgcatcagtttcttttacttcctggtttactatgaagaatggtgtggtttgagaagcagggtataaaatattgtatgaaataatatattttaaagactgnggtttgctgtcctgttttctgcaacaaatactttgtaatgccacttcgacattgttaaatgatgtgaaatgaagttcatttataatataactaacctaactcattatttct

SEQ ID NO: 23633 - DNA, 543 bp, Homo sapiens
acagaaggggtagatagtaatgaagttttagtatcttaacagcaattatgaataaagatatagaaaactgtttttcactagagtgatrttacatttgttaatcttagaaattgactatttgagatttttctaatcaaattaaaatggaaagtgtaatcttgctaatgttctttaaattacctctattgattgtctcttcwtatatccagatgaaaagatcatcagctatatatgatctagttaaagtcacttttaaggactgatataaattattgattttttcaaaaataaaaaagtagaccaatgtggtcttcagaaataaaaaaaaattacttgcttttaaaacattattaaaggcttgacagtcaaatggatggtacttagattaaaagaggtttttaaagacatggcaaatagtagtgtgcacatctgatacaaatcctgattcaaacaagttttaataaaaacaagacaatgcaaaatttgaacactgactacatatttgatgatttaaggaattattgaagtgtatgtatggtaatg

SEQ ID NO: 23634 - DNA, 678 bp, Homo sapiens
  misc_feature 100, 588: n = A,T,C or G
ggggtctgtcatgtcgtgctgccccttcgcccccatcaagggactgcagtagaagcagttgtattacaaggtggaccaatggctccttctgagggtttangatggctgactagaggagagcgggggtggaggtcctctctccggtggatgaacctgcaagatgaaatagccagaagctaggctgggcatggtggcttacgcctgtaatctcagaactttgggaaaccgagatctcgatgggataaccacattggtttgtttagtaaacactgagaccaactccaccatccagaggcctgacagacaaatggcctgagacagggctgggaaagttttgcttctggttgggacttcaggaagagttttgttttgttttgttttcccccaagggaacaagcccttgaatccgggaggccaaggttgcggtgaaccgagattgcgccattgcactccagcctgggcaacaagagcgaaactccgtctcaaaaacataaaaagtaaaaaagatatgtacgtcaatgtcagactttctgtgctggatggaaggactctgagcctaccaaaggaagcgtatttacaaacctctangtactgacttgttgctgaaggtcagaaatttgcaatgacatttggatgtattcaagggtggaggggcaggtttggggaaagttcttttaa

SEQ ID NO: 23635 - DNA, 277 bp, Homo sapiens
gaagacgacagaagggtacggctgcgagaagacgacagaagggtacggctgcgagaagacgacagaagggtacggctgcgagaagacgacagaagggtacggctgcgagaagacgacagaagggtacggctgcgrgaagacgacagaagggagggttcgattccggagagggagcctgagaaacggctaccacatccaaggaaggcagcaggcgcgcaaattacccactcccgacccggggaggtagtgacgaaaaaaaaaaaaaaaaaaaaaaaac

SEQ ID NO: 23636 - DNA, 589 bp, Homo sapiens
acagaaggggactggcagcaacccagcgcttccattgctgacctctaccgacctctacctgtrrkmcttcytytmctrcmkcagakwcastgtttyyttcagtgmtytgwwsttccaamsccakggggaatatcacagaagtgaagtgcaattctcatcatgtcatatcaagagcacacactaacaaacaacatgacttattgctgaatattgaacttgatcacctggctgaggtagtgtttgccagatttctctgtaaaggtgaataaactgacactggaacattcaggaacttcttcatggtcatggtcacccagctagagtgtggaagccaggctgtctgattccaggatctgtgttcttaatcctatacataaggaagccataatgagtcaaccactatttttaagattcacagatgttcgggtccaattcaccagaatgccaagttatacagggttgtggaatcaaaaactgcaattagtaataaaatgtgatgctatctagaatgtttttcatacatatatatgcttcttgggactctccctgcaggttaagagaaattgagaaacgatggagaatttaagtg

SEQ ID NO: 23637 - DNA, 815 bp, Homo sapiens
acagaagggcgactagctgccttgcacattatcttcattttcctggaatttgatacagagagcaatttakagccaattgatagcttatgctgtttcaatgtaaattcgtggtaaataacttaagaactgcctcttctttttctttgaaaacctacttataactgttgctaataagaatgtgtattgttcaggacaacttgtctccatacagttgggttgtaaccctcatgcttggcccaaataaactctctacttatatcagtttttcctacacttcttccttttaggtcaacaataccaagaggggttactgtgctgggtaatgtgtaaacttgtgtcttgtttaaaaagataaatttaaagactatcacattgctttttcataaaacaagacaggtctacaattaatttattttgacgcaaattgataggggggccaagtaagccccatatgcttaatgatcagctgatgaataatcatctcctagcaacataactcaatctaatgctaaggtacccacaagatggcaaggctgatcaaagtcgtcatggaatcctgcaaccaaaagccatgggaatttggaagccctcaaatcccattcctaatctgatgagtctatggaccaatttgtggaggacagtagattaaatagatctgatttttgccatcaatgtaaggaggataaaaacttgcataccaattgtacacccttgcaaaatctttctctgatgttggagaaaatgggccagtgagatcatggatatagaagtacagtcaatgttcagctgtaccctcccacaatcccacttccttc

SEQ ID NO: 23638 - DNA, 588 bp, Homo sapiens
acagagggggrsgttgcctgtgggtgcccgcgaaccaacggttagcggtggcaggggctgactgagagcgtctgcttgacagagtctttctctgtcacccaggctggagtacagtggcacgatctcggctccctgcaacgtccgcctcccgagttcaagtgattctcctgcctcagccacccgagtagctgggtctacaggtgtgcgccaccatgcctggctaatttttgtatttttaagagagacggggtttcaccatgctggccaggctggtctcgaactcctgacctcgtgatccgcctgcctcagcccctcaaagtgctaggattagagataatggattctgaattaatgcatagtatagtaggaagctatcataaacctccagaaagagtatttsttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttcc

SEQ ID NO: 23639 - DNA, 386 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggbagggcdgtdtvtakmwmctksrarktsswssytgyagygarmmraaawmrmammamwrmactccagcctgggcaacaaagtgagattccatctcaaaaaaaaaaaaaaaaaaaaaaaacccctggggccctttttttccttaaccccaaccttaaaaaaacccttgggg

SEQ ID NO: 23640 - DNA, 508 bp, Homo sapiens
agacgacagaagggtacggctgcgagaagacgacagattgtgctctgttgcgataagacgacataagggtacggctgcgataagacgacagaagggtaccgccgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagkggkatcrkctgcrwgawgatsgayaratttgatttttgctttgggtgggctcctcttggggatggattatggaatttaaaccatgtcacagctgtgaagatctggcacaagatagaatgataaaaaaaaaaaaaaaaaaaaaa

SEQ ID NO: 23641 - DNA, 583 bp, Homo sapiens
tacggctgcgagaagacgacagaagggtacggctgcgagaagacgacagaagggtacggctgcgagaagacgacagaagggtacggctgcgaagacgacagagggtacggctgcgagaagacgacagaagggtacggctgcgagaagacgacagaagggtacggctgcgagaagacgacagaagggtacggctgcgagaagacgacagaagggyacggctgcgagaagacgacagaagggtacggctgcgagaagacgacagaagggtacggctgcgagaagacgacagaagggtacggctgcgagaagacgacagaagggtacggctgcgagaagacgacagaagggggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccgaaaaaaaaaaaaaaaaaaaaaaacccctgggggccgttttttccgtaaatccaaacttgataaaatcct

SEQ ID NO: 23642 - DNA, 677 bp, Homo sapiens
gacagaagggcagcccaaggagtctcctgttacaggtcagggagctgaatccctgtttgcaaaacacagcctgagctccgttcacttcctgctgtccctgcccctaggaatgtaggmtmrrrgrgyactccccaggcracctgtggttacagagtggtcagctgggggagaggaggtggagggtgtctgaccctgggctgggaggcaggtgcacttcggtgtcggatggggctcctgccctgatggcatcttctgtgctggtggtgggacgcctagacacttcccaaagaagaggcccctaygaacccagagttgtgaatgtgagggtgttggagagctgccacagctgtggggcccgctgaggggagcagaggaggagggggtgaggagctgacaaaggaggcgcagggcagcagggtggtgcacccaggtgggagcagcaagtgcaccatgcacaggccctggcacacaatagactctcagcacagctgccaaaagaagcattgagattgagctgggcacagaggcttgtatccatcatcccagcacattgggaagccaaggtggacgaatcacttgaggtcagaagaccagcctggccaacgtggtcaacatggtgaaaccccattgctactaaaaaaatatacaaaaattagccgggtgtggtgtcctgtgcc

SEQ ID NO: 23643 - DNA, 495 bp, Homo sapiens
gggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggatktsacgcctgcvagtwgwysmcwgrmsgggagcgttggctttcgcctgtaatcccaacactttgggaggccaggacagatcacttgaggtcaggagttcgagaccagcccagccaacatggcgaaaccatgtctctact

SEQ ID NO: 23644 - DNA, 485 bp, Homo sapiens
agacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggkrsksctrmgasmmrrsgacmsagcgactatgcccacccagaccccagagcgttcccataaccctgacagttctccacactgtgcatgcacccttgcttgcctttttcagaaaaaaaaaaaaaaaaaaaaaaccgcgggggccgttt

SEQ ID NO: 23645 - DNA, 424 bp, Homo sapiens
gacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacwgaagggtacggctgcgagaagacgacagaagggtacggctgcgagaagacgacagaagggtacggctgcgagaagacgacagaagggggaacacaatcacttctcaaacaatgacattctcaacatccaacaacaagaccatactggcatgtgtggccattttatctttttcacaaaaccccaaatcttatcattttacttcccaagctgggtgcagtggcacacacc

SEQ ID NO: 23646 - DNA, 820 bp, Homo sapiens
agggtggaccaccatgatacggmatctcgttttgatggtcttgggaaaagctgcagtatgaagccggcaattttgcagttaaaatgtctctggttatggccttggatggttggtgaactctgtgcggtccacacgtcaggcacaatacttgtcccttgatatttatgttaagttgttttgttttagctcgcagggcatttatgaaagagcagcttccagttttaataattccgtaggagaaaactggattggaggaacttagaatttagggtccaatatagtctacaggtagatgataaaactgatctataaacaatttaaatatgacattccaaagccttcgtaatgttacaggatctctggggtgttgtttttctggctggaaatctgtggctgttggcgccttggcccgagttttgcccgtttccactgaggaaaaggagtcatctcgtatgtccactgtccagaatctccactcttccacccctttgctgatttaagtaagagtgatgacctgctccctgcaggcactgaggaatacatccatgcaaggatttaacagagaaatgacaggaaaacccttagcactgtctaagcgatcactaaggattacaataaaaagcaactagtgaaggcatttaagaggaaatttccctgcaatgggacggtaattgagcatccagaatatggagaagtcattcagctacagggtgaccagcgcaagaacatatgccagttccttgtagaggtgggactggctaaggacgatcagctgatggttcaagggttttaactacttgtggctcactgaaacttaagt

SEQ ID NO: 23647 - DNA, 565 bp, Homo sapiens
acagagggcttcctcagactgagaactgtttccagtatatacatcaagtcactgagagaacatcaccaccctgaagccagagactaacactgcaggactcagcaggactatttaagaaacaactgaggcatcagaccaactttccccacaagtcctcggatctttcctgccatgctgatgccatatattccaacgtgatcaacctggctccccagaaggaggacgactttgctgtctacaccaacatgcccccttttcatcaccccaggaggacattgccagaccaagtggaatatgtctccattgtattccactgatgggaagctaatgagatgctcagagtgggggtcagacctggccccagctgaatcttggcataccctttgctttagatttatgtgtgtgtttaaaaaaaaaaaaaatacataggccaggcacgggggctcacacctgtatcccaccactttgggaggctgaggcaggcaaatcaccaggtcaagaaatcaagaccatcctggccaacatggggaaaccccgtctctactaaagatacaaaaattaccca

SEQ ID NO: 23648 - DNA, 629 bp, Homo sapiens
gacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggatawcwgcttccctaactagtctaccatacattatgataataccttcatctatcacagaggacacataacgagaaacaccaaatcctttaaacacagagtttgggattacaagtggcaaggctggggaatcacttgagcccaggagcttgagaccagctgggaaaccagtgagaccccctatctctaccattaaaaaaaaaaaaaaaaaaaaaaaaaaaaaccccggggggcggtttt

SEQ ID NO: 23649 - DNA, 733 bp, Homo sapiens
  misc_feature 466: n = A,T,C or G
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggggtmmrscwggaattgagtcactgcatctccctgcagaatgacaaatcatgctctccttantagctttacaccagttctgtttgcaaattggggaactgaaacatcactgtaaaattggtgccttttgtatcttatacaatagggctcattcattcattcaccctttcattcactcagctgtttatttagcaactgattattgagtgcctcttccatgaggggacaggcatgtactaattttgggaataaagagatgtatattgtgatcctaaggagaagcaaaatgtcctggcacatagtaagcactcaataaatatatattgaata

SEQ ID NO: 23650 - DNA, 566 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggytgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggctwygkmtkcgasaakmykwcwraaskkwaykrmtkckarwwkatckaywkmwrkstacakrmtryswgwrraygaswkwwskktwmrrmtcttacagcttttttgttcttacaatattgcatttctaagattgccagtctagtacagtgttgaataaaagcaatggtagggggcatatttgtttcattgctgataataggtaaagttttcaaca

SEQ ID NO: 23651 - DNA, 564 bp, Homo sapiens
acagagggggtgcagttaaaggaaggtttttcagacttaaagtcattagactctccgcactgaactgaatacctggccttgggcgcttgcacagctttagcccattttcagattcttcttaatcctttggtgaaaactgagacacaaaatggctgcaaataagcccaagggtcagaattctttggctttacacaaagtcatcatggtgggcagtggtggcgtgggcaagtcarctctgactctacagttcatgtacgatgagtttgtggaggactatgagyctaccaaagcagacagctatcggaagaaggtastgctagatggggaggaagwccasatcgatatcttaaatacagctgggcaggaggactacgctgcaattagagacaactacttccgaagtggggaggggttcctctgtgttttctctattacagaaatggaatcctttgcagctacagctgacttcagggagcagattttaagagtaaaagaagatgagaatgttccatttctactggttggtaacaaatcagatttagaagataaaagacaggtttctgt

SEQ ID NO: 23652 - DNA, 809 bp, Homo sapiens
gaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctcttagctccttagtctagaggggtctcctggctccatttgaccctggtctttaacagaagggcagcatcttgctaccttctaccacctttccaaatctctggaaatcctgccagggaaagcctccagttccaacattggctttccaagcaaactggctttgccctctctctgccatccttgtcctccaragactgcaccacctgtagcatagaaaaccaccaccacggacctgccagccattggcgcagcaaaccagccagctgtttgctgccaaattccttcctctcccargtccagaccaaatacaagatcagcaccacaccgtggtgttgtcaggagccaaagcaacaggaaacaattcaatgctgttgggttcgattctgaragtagatttttccagacatgtctttcaggtgaccctcaactacctcaggtttgaaggccctaaatgaaactgattaccactcatagggacaaaccgagggggttcggttacatcttggtgataatgcagttgtctcaaacttataacagactctttcacatttcagtttgcagggatagggttgggtttgtttttcttctgtttttaacctttcccctgggtttcca

SEQ ID NO: 23653 - DNA, 773 bp, Homo sapiens
  misc_feature 640: n = A,T,C or G
gggatttctaaacccatgggtggcaaggcaggaccttcctaatccttgcracarmrkkgggcccattttctttccttcacaccgatggaagagaccattaggacatatatttagcctagcgttttcctgttctagaaatagaggctcccaaagtagggaaggcagctgggggagggttcagggcagcaatgctgagttcaagaaaagtacttcaggctgggcacagtggctcatgcctgaaatcctagcactttgggaagacaatgtgggagaatggcttgagcccaggagttcaagaccggcctgagcaacatagtgaggatcccatctctacgcccaccctccccccggcaaaaaaaaaagctgggtatggtggcttatgcctgtagtcgcagctactcaaaaggctgaggtgggaggattgcttgttccccggaggttgaagctacagtgagccttgattgtgtcactgcactccagcctgggcaacaggtaagactctgtctcaaaaaaaaccaaaaaagaagaagaaaagtacttctacagccatgtcctattccttgatcatccaaagcacctgcagagtccagtgaaatgatatattctggctgggcacagtggctcacacctgtaatcctancactttgggaggccaaggcaggtggatcacctgaggtcagaagcttgaaaccagcctggactacatggtgaaactccatctctactaaaagtacaaaaattagctgggcatgatggcacgcacctgcagtccc

SEQ ID NO: 23654 - DNA, 766 bp, Homo sapiens
attcatcaagtcagataaagggtttaaaccagtcagagaaactaggtggaatggaaaagtactgagagataattggggacagaaaaataaaagagatgggaaatgctgcatcaaaatactcctacctctaggatgttactatatattgttaggagaattcaagttattgaaacttgccaaattcttgagtgaagaggaattcatttgagagccaaaatttgactaaggaaagaagaccaacatgggctttccaaagttgagtttgaattctkccatccccactaagcagtcatgtgaccttggaaaaactccctactctgagtctcagtttctttatctgtattaggtttcaacaaagggaataaatcattggcttctcatgaggttgtcataaggattaaataagacaatgcatataaaagaactggcagacaataaatatagagtcccccactcctgcttggtgctctctttctctctccttctctacatagagaagtgccagagcatccgtcagtagaagttacttaaggttggctgtgtcttccacatcttttgtttacccatgaagaactgtgaccatcttgttctgtgtcttgtcataaagatgggacgtgacttctttctgctcttgcttccatctggtgctgttttctgcacagcctccttgagaccttccagaaccttcttttttcctacttcatatcacttaaccagtagctatctgggatggttccagaagctgaagtttgcagttgaataacat

SEQ ID NO: 23655 - DNA, 871 bp, Homo sapiens
ggagaagtgttgatgggagcccaacgctgaggtcgcccttcccacaacagccaccaggcaccagctggaaacctgtgggcttcacctccatctgtgggcaggaagcaagtggatgtcagggacggtggtggggggctctgcttggaagttttaagaccacactcatcttttgtggccatggacttttcaataccatcctaagtcaagattttttgttgtttgttgttgtttttgttgttgcccatgacagaaaactcacctcaaaatgacttaaggaaagagataaaggagaagaaagatagttaactggctcatgtgattgaagagtacaggggaaacgaccttcaggccaggtgcaagggttaaggtaattttgtttcactctcttcctagggtcctccttcctctgtattagctacactctcagatcctgtcctgcccccagcagctccacagggcttccggttcagaccggaagaacaggagaacagaaggccacgtgcttctcttccaaatgcccaggaggaaaaaggctaattaagtctcattggtcccaccaggtcacatgtacaggctttagccaatcactgtggtcagaggtaggctatgttttgattggttaggtctgagtcacgtgatgagttccaatacaagcacaggaaggaagataaggccagaggatgttctctagagaaaaagtggggctatgtyacctgaaccagtcagcacacatgttcagatattctgatcaagttcagaacaacagcctgctttgtctaatgcttgcatttcattttgaaaagttgttatacattggcagcctctgagctgaactactgagggtgtggcctactcatttgcagggtgcact

SEQ ID NO: 23656 - DNA, 656 bp, Homo sapiens
cacctctattgtatgtgttttttttctctaagccaatatgagwmagmwrsrggatatgacaccccttgacctcttaatatttcagtgtatttcctagaagcgaatgcattatcctatatagtcacagtgcctgtaaccacaccaggaagttagtattgccaccaggcctcacactgtgtgcagtgatgtttcacaggctcacccactgtatatagtgatatttctagtccccttcagtcaggaacggtcccttgcctttctgtctttcctgaccttgacccctccagagcatgtggccgccccttaggctgtctggtatttgctggtgactaggcccagcatgggctttgttgggaggagcaccgtagtgggacacctggtcctttccaggtgcccttttatcaccgggttaaaaaggtgccggtcaggtttttccattgtaaaataattactttgtgcccagattaaatagtaatgaggctgggcgtggtggttcatgcctgtaatcccaggactttgagaggctgaggtgggcggatcactggagctcaggagtgtgagaccagctcaggcaacatagcaaaatcccatctctaccaaaaatttaaaaataaccaggtgtgggtggtgtgcgcctgtaatcccagctacttgag

SEQ ID NO: 23657 - DNA, 1382 bp, Homo sapiens
  misc_feature 1204, 1214, 1312: n = A,T,C or G
gacagaagggaatgtaaacctggagtctcatttaagaatgatcagcaatacgtttagaacatatgaactgaatgaaatggacattttttcttaatttacgtataaatccatatgattatacataaagttctgatgcattaataaaagcagccaaatagggccaaagagaaaaataacaggactctgtactggacctaactttatcattaattaggtaatattttcctcatttctttactgctgccattttcctcaccagtattccagagatggtcatagctcattactctaccaccaagaacctaaaaggaattagaatacagcagaattggcctcagtgaagagcttaaaattgttctcctcgtagaactggactattgatcattaccacgtgacgttggctctattactttctgttcccaatgtccttctagtggtttgaaaatgttaaaacatccctaaaatctaaatcatataatcagaattctatagtgtcccactctatctgtaaagatcatttggaagactttagactctattaaywkwarrrggaatatttattagccatatgcagaatttctaatgatgatatkgtacagcttctaattcacttttcagatcagtgtttgaaatggcaattatcagtgttggatttagttccaactacttgatttacaaaaatgtacatttagagaaggttaaaagaaacagtgagaaatgtaaacattcaaaatgataattgaatctctcagttgtgggaataattatcagagacatgcaactgaaaatgtctcacctttcatctttttttcttaattcataaagttatcttgtagaatttgatgagaccctcctagtcattctcaactggggcggtgctgtcaccgaatggtgtttgagagtgttggggctagggcacatttttggttgtcacagcaactggggtggcatttgctgcccagtgccaggaatagtaacattatgaatgccagggacagtgtgctcagtaaagtcttccatccaaaaggggcagggcacggtggctcacgcctgtaatcccagcactttgggaggccaaggtgggcggatcacctgatgtcaggggttcgagaccagcctggccaacatggtgaaaccctgttgctactaaaaatacaaaaattggctgggtgtggtgtcacatgccagtaaccccagctactanggaggctgangcaggagaatcacttgaacccgggaggcagaggttgcagtgagctgagattgcaccactacactccagcctggatgacagagtgagacttcatctcanaaaaaaaacaaaacaaaaaaaaacaacccggtagcattgtcccttccccactgacaaacttatcaaatcc

SEQ ID NO: 23658 - DNA, 1152 bp, Homo sapiens
  misc_feature 509: n = A,T,C or G
atgatcggagacatcctgctgttcgggacgttgctgatgaatgccggggcggtgctgaactttaagctgaaaaagaaggacacgcagggctttggggaggagtccagggagcccagcacaggtgacaacatccgggaattcttgctgagcctcagatactttcgaatcttcatcgccctgtggaacatcttcatgatgttctgcatgattgtgctgttcggctcttgaatcccagcgatgaaaccaggaactcactttcccgggatgccgagtctccattcctccattcctgatgacttcaagaatgtttttgaccagaaaaccgacaaccttcccagaaagtccaagctcgtggggcttgcttctgacatgtctgatgagcgcattcctgctgttgctcctggctattacaaggtgtcgctgtggaagactattcctgtacagctgtgtgaacctgcctcgtcacggcttcctctgcagtgctcttgaatatcccggttcctgcttangccacagcagtgagtccagggagaagcatccttctactccctcactgtccaggttggctgaagatgctctgcacttgacctcctgacactaacttccttgccttttcccatggcaagagcaagtcatggactctgaactacttcctctcccttttttctatttattttattttattttatatttgtgatggagtctcgctctgtcacccaggctggagtgtggtggtgtgatcttggctcactgcaacctctgcctcccaggttcatgcaattctcctgcctctacctcccaagtagctgggaatacaggtgcccaccaccatgcccggctaatttttgtattcttagtagaggtggggtttcaccatgttggtcaggctggtctcttaactccttacctcaaatgatccacccacctcggcctcccaaagtgccgggattatagatgtgagccactgcacccagcccttcctctccctttctctttggggttcccttcacaaacaggtgaggcagctttttcaagggcattccaagcacaaaagaccttgttgtacctaaatactataagggacctgtcattgaggacgaaccatcacagcaagaggaattatctcgtgccgcatcttcgcataactgacag

SEQ ID NO: 23659 - DNA, 583 bp, Homo sapiens
acagaagggatgggtctcactatgttgcccaggctggtcttgacctcctgacctctgctgattccccccacctctgcctcccaagtagcgggattacaggtgtgagccactgtgtctgacaagaatttatacttaagcataggagatggttctggaaattctaagaaattctgctctcagtaagagtagaggtttggagctttacctcttggcagtatcccttggaagggagcyctgagattaaatgtaatcaaacacttattgagagctttctatggaccaggcactacactagacgctgggaattacagaggcaattacctgtcctatactcaaggtgttaatgatctagtgtcatttttctttaaaaaagaaagcacctgcatttgtcatcttgagcaaatatagtaactctaacctcaaggttcaagtgatttactcaaggtttaaatcatagttgttttggagaaagtaagtgtcagatgcactgtggctgtcagggtcatagtaggcattaaatcaacatggttggtgttcattaaatgtggattgaagataaaatgactgatcttaagtttcatga

SEQ ID NO: 23660 - DNA, 736 bp, Homo sapiens
gggcctgccttgggcctgcccgacccagggggtcacatgccttgttcssctcaacccagacaccgactcgcccaagggtcttccagctggctgagttggaacctgcattttttaaccacaaggaaaagaagcycagagctaccaagaataatattttattgacttggaatgagttttggaatctgtatttttaacaagctgcccagtgaaaaccatttcctcctcgtcgtggcgcaggttcbabaggctgcgcccatctctcccacgtcaacagtcctgtgtccttggcgaaggactgttctctcattcagtgcctttcctctcttcctgggccaaatccctgctttgcgtctccctgcagctcataaaaagctgaattacctgaggcagggaaagccccacccactgtcattctcagggaggagtggagtctgcagaggccgcaatgcacagcttccctatccccctccacccgtgttttcccagagcagctctgttccaggcccgggggtgtccctgggccgagatggaatccagccctgaccacctcccaaagccaacagccctgagtgagcgtgcagagaagcaagagctgttcctgatgcagagcaaagacatctcccagtcaagggggatgaactgatttgggacaaaaggcagttgttggctgaggaaggcaggatctgggggagccctgtgctgagtggaggtgggtgggtgtatttccttggctcac

SEQ ID NO: 23661 - DNA, 741 bp, Homo sapiens
  misc_feature 673: n = A,T,C or G
tgaatgcttaagtcatccctttcctgtttgtagaatactaccctattccactttttcctgtttggatgctttcttacttgtcctgttagatccttttaactcttataaggtaaacagagagagttggtsskgtattcatgatgagacagttaagacacarcarattaagtgaccagtgctatttgtttgaagaacttartttattcttctgtgtacttattttccacatctgcagaactgtgaccatcctccacataatttatagtccataccaagtagtggatcaaacgagctcctgccaggcagtcaccagcttctgatgagaacagcagcatgcagcctgcacttcaatgctgcactcccaagaccagctgyggcccccacactgccagtgctgtgtgtaacgggtgctctgtagtycagtattattgatttcctatagattctttattttttaaatagcccatgtcagtttctytcttttaagtgtgggaagggtcctaagctttagtttcctgttctgtaaagagggatgatactctttgccttktttatctaccatgcaattattatgatcaagtgagattatttttgtgaagccatgtaaactataaagtgctttccaagcatgaggaattactgtggatgatcttgagtttcacatggaggtcangagcagttaaaattgttggttgtgataccatccataatctcttctctcaacaccctctgcaagctcta

SEQ ID NO: 23662 - DNA, 773 bp, Homo sapiens
acatacacacacttaaacacataaatactagtgtgattatatctttggagtttgcaatatagcataaaggacaagtagaactgcacattaagaywrmmkrscgaagcaactagatgtggctgggacacaatcaaaggaggaattttgtccacaggaaggtgaggaaattccaaatgaagcctagatcttcagtatcataaaaaggcagagctggccaggcacagtggctcatgcctgtaatcttatcactttgggaggctgaratgggaggatctcttgagaccaggtgttcaagaccagcctcatcaacatagtgagaccccatctctattaaaaaaataaataggcagagctaaactaaccccagtgtcacaaaactcaactggtcatataaatgagtgaaacaggcctctcacacaagcgatgtaaaacagctgggagcagtgggagctgtggcaaactaaagtgcccaagccgcatttaaaaagggcatctgttcagctccatctgcttgctgcggtgcaagaatgctaaaccaggattaccagttcttcacattttttgaaatccaaattttcatgagaaacattctcatttttaaatatcaagaagtgattttaaaatgtttaaatggtgctggttaaacaaacacgtctgcagcyggatttagcttgcaagctgccaagttgcaacctctttcattctagaaacttctgtcattttcatcatagcaagtctatgcggacaaaagcctccaaactttccaactgtgt

SEQ ID NO: 23663 - DNA, 822 bp, Homo sapiens
gtgatttattttctctatagatgtcaacaagatacacttgccttgtatggcaaaaataaattaattttagctttgtgcagatacatcctattgagttacaaagtgatgctatcaaacaccattgacaacaacaaattcaggatttatggctttctttgtctctgtttctctctccttctctctctctctctctctctctctgtgtatatatacatatatgtatattatacatatatagtttaagatacatgtgtatttakrkataattttattttttagaacaaaattaaamataaagtgtctttaaatgaaagtctgtgtttgtaacacaatcttatgacatcagcattaaaaaggctattcagaacacttcctcaaattgaaactattaccaatactgagttaaatattttaggactacttcattatctaggaaatttgagaagcaaattaactctttgctcagagtattgtgataccatatcttttcttgtaaaataagatattgtttaattataaaatattgtcaaatttctgaaaaagtgtttatataagtgttaggaatatgttagcyctgggagccatgtgttactyatcattgtacagatcttcttgctgacacaactgggtatggtagacggcctgatatgattaactgcaagtaaagcagaaattattaaaaacaatattgaggccaggcaaggtggctcatgcctgtagttccagcactttgggaggtcgaggcaggtggatcacgargtcaggcattcaagactagcctgaccaagacggtgaaaccccgtctttactaaaaatacaaaa

SEQ ID NO: 23664 - DNA, 905 bp, Homo sapiens
acagaagggggttatttgtttctatgaaatttaaagatattgaaggatttagtttttaaaagtctaataaagtaccttataaccactttatgatagtatatttgtaaaaggtgctctgtaatatacccctgtgcaaatagagacatcaatgataagaatcacagaatgatggataatttaccagggttcctcacctgtcacacttataagagttacttggtttacaggatttttgtagtcatttcatttatgattattctggaaacagtttttttgacatattttatctcaggtaatataactagtttataatttgtagttcttctttcactcttccswcmgctmaksgtattgtactattataatgagattatggaaaattccactgcatttgtggcagatgaatgtaaaatagcataggaatccagataatttgaagatatatgagtcctgcattttggagctggccaaaagtttgattatttgccagaaacctgtgagtgggcgtagcatttagacagggacctttattccaaagtagccctggtttaatctggcatgttggcgaaagtacatactacacatacatctgtgtatgttaatttcttctaatctcatattttctatttagwcttttaataattccctaaaataactatttcagttgatatttactcagtggcctaacttgaatcctatgactctttctctgccataccatgaaggcggttagttttgtctattttgtttactactctatcccaattatctagcacaaaacctcacattacaagaccttagtaactgattgttgaatgaattaatcagttccacacccttcctagtccccactcttcagttgtttattcattgaacgaaagtttattgaaaacctattattggct

SEQ ID NO: 23665 - DNA, 951 bp, Homo sapiens
gcagtttttgctctgaaatatatttatcatgtgtttggtacctaatattatgctttctcatgacagtttctcaacaatcctgtgaggcaaattcgcatgtaccctctgtattagtgtgttctcatgctgttgataaagacacacctgagatggtaatttgtaaagaaaaaggtttaatggactcacagttccatgtggctggggaggcctcacaatcatggtggaaggtgaaaggcacgtcttacatggcggtggacaagaaaggatgagaactaagtgaaaagggaaacccttttaaaaccatcagatatcgtgagacttatttactaccatgagaacagtatgggggaaacaactccatgattcagttatctcccaccaggttcctcccacaacacgtgggaattataggagctacaattcaagatgagatttgagtgggaacacagccaaaccatatcaccttcaaagaagaaataagagaattattagtaatttgctcagaatctggtatgtggaagagccaacatggggacccagccttttgtgattctaaaacctttgatctttctactaacattcactgttagagagtgtaggcgctgcaggagaaagagaaagtgcccacgaaaattagtctagcattgccgggggtaaaaagcacacactggtcctgcagcttattgaatcagagaaatgtgaagataagatgaactaaacaaacatattttagagcatggatctcgaagcagaatttggctaaattttaacaaaatgttcttcagtaacacatctcatgatctgaagattgtgttacaaaaaatattatcaggccaaaatttgttcggaatacactaatttttgctcctctatatgtgaggaaaatgagactagacatatttaagtaattgacaacttacttaaagtagcaaagtcatggattgtattgac

SEQ ID NO: 23666 - DNA, 766 bp, Homo sapiens
acaagacccagctcctaccttcaaataggtcatagtttaatgtaatggacttcttctagaatatgaaaacttcggaccttctctgcagaaaaatgcatgcaaacattttacattaattttcaaacattcactacttctctgaaatccatccatggactctaggtcagcaatccttggctgattaatgggtcacctgtgggacaaccatattctttcgtcaatagtccccttctggaatcatcccttggaacatgagaatggcagatctagaaactagttattgagagtttcttttggacaataaccatctcttttgggtgggtctgttagggtgttctaagactaacataacattgttctttcttattagctcaacgttgacagtaatgaacaaggctcctatgtagtggccatggaaacctttaccaacttaggacccattgtcgatatgtgcgtggtggacctggagaggcaggggcaggggcaggtaagggccattctgaaagtggatagttggtatatgcccactcaaactgtgtcctcctagctatgcttatctagaatggggagggtgcactgaaaatacttttaagagccccctcatgaatcccagtgatataaggataactactgtttattgagtgcctatcttggtctgccaggcactttatatayattatctctaattacacaagtaccctagatagggatatttggccatctcagaagtgaggaaaattagggctgagaaagattaagtaacttt

SEQ ID NO: 23667 - DNA, 1057 bp, Homo sapiens
ggtgaccacatatacataggaaagttgaatttgtacacatacagcatctgaaatgtatctgatgttcagcatcaagatttcactgaacattgtagaaatgtgtatcttttgcatgtatattttacattgattttctatttatgtacatctagaaagttttaaccctaataaatagttttgtaattttgaataatagtgtcagtttatatgtgagggagtagagacagagaggttagcactgtataataattagtaaggccaaaggagaaaatttcatcgaaaatattgttgttgtcataatgagtacagcatgaaaggcttcctctacaagacactagtcaaagagttgagagctgcggtttctaatctttgtccattactcccttactccttatgagactgtggacctgtcacttggcctctctggtcttcagttttctcaccagtaaaacaaggaacttgaaccaaatgacctctagtgttccccttgggtttaaatgtctataaatgttcaatrrskagaatgtattgcgtttttctttattctttttgctttgagaaaagagaatgtgatttaagagtaataatttgaataccaattatccacattaaaattgtgtcctctatgtgtaaggcatagcacatttagcacacatacataagcacactaagcaccttacaaatatcctcatttattctttacataatcttttgaaattgattatgtaatacacactgtttttgaacaattggtgacttccagctgtttaaaacaaactacagtatggtgcttgagtactgacttaggaggtcagcattggtttcactaggagcttctcaaagcacgctgccaaacatgctccagtctcattgtcaaggccttagaccaggcaatcattacggcagtggttcttcaacttcagcagcagcaaaacgatctggcgggggcttggtgaaacagactgctgggctcgaccaccagaatttctcattcagagggtctggcctgatcacttgcatttctaatcacttcccaggtgatgcagatgtttctggt

SEQ ID NO: 23668 - DNA, 443 bp, Homo sapiens
  misc_feature 1: n = A,T,C or G
naagacgacagaagggtacggctgcgagaagacgacagaagggtacggctgcgagaagacgacagaagggtacggctgcgagaagacgacagaagggtacggctgcgagaagacgacagaagggatacggctgcgagaagacgacagaagggtacggctgcgagaagacgacagaaggggtacggctgcgagaagacgacagaagggtacggctgcgagaagacgacagaagggtacggctgcgagaagacgacagaagggtacggctgcgagaagacgacagaagggtrcggctgcgagaagacgacagaagggmackgctrmragragcwckamakmwkgrwacrrmtsckagaaasacrwcaraasrgwacscctttaaagcataaatctcacaggacttataaaatgaaaatacgaaggagaaaaaaaaaaaaaaaaaa

SEQ ID NO: 23669 - DNA, 484 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggwkatwtatyagtrwttaakakgyagykttaattgccatrawcattcccwcwtkttggatgtataakaacmttccggamaamrkawsytatwtctkgaattgcagaagataacatatttcccttattttgatttaatcaccataaaccatacctatttaatgagtgtattctgtgcaatttttttctc

SEQ ID NO: 23670 - DNA, 1000 bp, Homo sapiens
  misc_feature 359: n = A,T,C or G
gtacggctgcgagaagacgacagaaggggtacggctgcgagaagacgacagaaggggtacggctgcgagaagacgacagaaggggtacggctgcgagaagacgacagaaggggtacggctgcgagaagacgacagaaggggtacggctgcgagaagacgacagaaggggtacggctgcgagaagacgacagaaggggtacggctgcgagaagacgacagaaggggtacggctgcgagaagacgacagaagggggggggactcagcatggtggggctagcatgagggagatgggtactaaggagtcattgcggaagaaaactcttgttggagtggtgggctagggccagatccccatcanaaggagccgtggaatggttttagtaagctcattctgtcaattgtgctgaccacagtaagggaggagagcaatgaaggtgctacatgggcgaggaggagggtctggacaagacccttcgctctcctagcctcctggctaccaggtccctctcaactgcaggaaatgtatgaagaagacttggggccagagatcagactcaggagagctgagagggccctcggacaccccaggggagaagtgaggcaggtaagtgccgggcttcaggctctgtgctgggaaagtgtgcaggcagcacacagcccactttgaactaggaattacattcacatggtctaagatacaaaaagaacaagggggccaggtgcagtggctcacgcctgtaatcccagcactttgggaggctgaggcgggcagatcacgaggtcaggagatcgagactatcctggataacatggtgaaaccccatctctactaaaaataaaaaaaattagctgggcatggtggcgggtgcctgtagtcccagctactcgggaagctgaggcaggagaatggcgcgaacccgggaggcagagcttgccgtgagctgagattgcgccactgcactccagcctgggtgacagagcgagactgtctcaaaaaaa

SEQ ID NO: 23671 - DNA, 363 bp, Homo sapiens
  misc_feature 1: n = A,T,C or G
naagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggcctcatttgtcttttgtttgtttataatttgaaaaaaagtcatccacagctctatcacccacctacaatagtcctttcctaatttcttgctataggcacactt

SEQ ID NO: 23672 - DNA, 525 bp, Homo sapiens
  misc_feature 22: n = A,T,C or G
gacagaagggtacggctgcganaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggcttatttytryttcactttgwtgcatmtgtytwwtkyysrcatggcrgwrwcsctttmtgramatagmtwgsatgtwkmmswytwtgyytkmtaaatgkagawrwwykrytaagttaawswcatsttatasrcwcmtttccaacytgggcctggcacaatggct

SEQ ID NO: 23673 - DNA, 622 bp, Homo sapiens
acagagggggccggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaagtagagacggggtttcaccgtgttcgccrggatggtctcgatctcctgacctcgtgatctgcccgcctcagcctcccaaagtgctgggattacaggcgtgagccaccacgcccggcaggataacatcttaacatacatcccggagttgtctttcagaggcttggaaccccactgaggacccccgctgaacagatccattcactggcacagactcctagataaggaagaagtgaagactaaacttgacctttgttctgtttcttccttgggggattagagaaagtcactccctgtaaccagttatttttctactgacccctgtcaggcctctgagcccaagcctgcacgaatacatccagatggcctgaagcaagtgaagaatcacaaaagaagtgaaaatagctggttcctgccttaactgacattaccttgtgaaattccttttcttggctc

SEQ ID NO: 23674 - DNA, 491 bp, Homo sapiens
gattctacagaattaagttagcagtaaggtgataatacctggcatagtatggtggctgagtaaggaaaggatataagtcatttcaaagaattaggcctggttactgacaatagggcatgaacaaaagggatgaattcaagatggctttaagcctgcttggaagatgtaggtgacattggcagcgaggcaaatcagtgttaggtctcagcttctaattcgagtggccctattaatctagggagtacactctagggaaggtggtatgtggtagaatagaggctttggaattggacaacataggctttagaattggacagaaatggtttccaatccattggctgtgtgattgagcaaactgcttaatttcyctgagccttatttactaatgtgtaaaatgagaacttaatgagatgagatttcattatttctctccaagaaagagttaactgcctggtgcggtggctcatgcctgtaatcgcagcactttggga

SEQ ID NO: 23675 - DNA, 650 bp, Homo sapiens
  misc_feature 424, 449, 499, 506: n = A,T,C or G
gggttttcattksasswwkcksarkamtamtgrsygwagcttatywwgactytgwcmtktgwkwaaacawkwmatgacccttggctcttattgttcttgctggtgtggtrtgttcacggctgaaaagatggtcagaaggggaaaggaggaagtgagaagaaagaaacagggaaatgacagagtgttgctcagttacccaggctggagtgcaatggcatgatcttggctcactgcagcctccacctcctgggttcaagcggttctcgtgcctcagtctcccaagtagctgggattacaggctggagtgcgatggcatgatcttggctcacggcaaactccgcctccctggttcaagtgattctcctgcctcagcctcccgagtagccgggattacaggcatgtgccaccatgccccgttggccangctggtctcgaacaccttacctcangtgatcctcccacctttgggattacagcaggctgaggaattaccaaggangcaggangtggagcaaaacacaccaagcctggtgccaatcattgacaatattatggaactgactcagcgcaagaagacagcttcgactccttgtgatttcatccctaaccaatcagcactcctggctcactggcttcccccacccaccaaa

SEQ ID NO: 23676 - DNA, 636 bp, Homo sapiens
acagaaggggagaaggtctgcagcttcactcctgagccagcaagaccacgaacccaccagaaggaagaaactccgtacacatccgaatatcagaaggaacgaactcctgaaacgtcgcctttaagaactataacactcactgcgagggtccgtggcttcattcttgaagtcagtgagaccaagaacccaccagacacactaagactaggtaatttataaagggaagaggtttaattgactcacacttccacatcgctggggagacctcacaatcatggtaaaaggtgaatgaggagcaaagtcctgtcttacatggtggcagggaagagagcttgtacagcgagctctcatttgtaaaagcctcagatcttatgagacttactcactaccaggagaacagtatgggagaaaccacccccatgattcagttatctgcatgtggccccgtccttgccatgtggggattattacaattcaaggtgagatttggctggggacacagccaaaccatattaactaatgcactgcatgagtctgtacctcctttgaggtctaaaaattaagcaactttctcagggttatacaactggaacgtattctcagtctctctatgcttcccaattatctgggatacta

SEQ ID NO: 23677 - DNA, 373 bp, Homo sapiens
tacggctgcgagaagacgacagaagggtacggctgcgagaagacgacagaagggtacggctgcgagaagacgacagaagggtacggctgcgakaagacgacrgaagggtacggctgcgasaakacgacagaagggtacggctgcgakaagacgacagaagggtacggctgcgagaagacgacagaagggtacggctgcgagaagacgacagaagggtacggctgcgagaagacgacagaagggtacggctgcgagaagacgacagaagggtacggstgcgagaagacgacagaagggtaacacaaagcacccaacttacacttaggagrtttcaacttaacttgaccgctctgaccaaaaaaaaaaaaaaaaa

SEQ ID NO: 23678 - DNA, 474 bp, Homo sapiens
agaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggtwckkstkskwgaarwmsammgawggktwyksmtrysattggtcgtggttgtagtccgtgcgagaataccaaaaaaaaaaaaaaaaaaaaacccctgggggccgttttttccgta

SEQ ID NO: 23679 - DNA, 698 bp, Homo sapiens
  misc_feature 48: n = A,T,C or G
ctgttaatcatggatgttagagctcaaacgggcttttatatacactangaattcttgacgtggggtctctggagctccaggaaattcgggcacatcatatgtccatgaaacttcagataaactagggaaaactgggtgctgaggtgaaagcataacttttttggcacagaaagtctaaaggggccactgattttcaaagagatctgtgatccctttttgttttttgtttttgagatggagtcttgctctgttgcccaggctggagtgcaatggcacaatctcggctcactgcaagctccgcctcctgggttcaagcgattctcctgcctcagcctcctgagtggctgggattacagacatgcaccaccatgcccagctaatttgttgtatttttagtagagacagcgtttcaccatgtcggccagtgtggtctcaaactcctgacctcatgatttgcctgcctcggcctcccaaagcactgggattacaggcgtgagccaccacatccagccagtgatccttaaaagattaagagatgactggactaggtctaccttgatcttgaagattcccttggaatgttgagatttaggcttatttgagcactacctgcccaactgtcagtgccagtgcatagcccttcttttgtctcccttatgaagactgccctgcagggctgagatgtggcaggagctccc

SEQ ID NO: 23680 - DNA, 653 bp, Homo sapiens
acagaaggggccaccacacccagmyarwwkkkgtatttttagtagagatggggtttcatcatattggtcaggttggtctggagctcctgacctcaggtgatctgcctgccttggccacccaaagtgctgggaattacaagtgtgagccaccgtgcccggcctcataatttctagtaagaagatgctagtgatatgataggcattgccctcaacgacatgataaaaaattatatttcatgttttaccatagccctttatgcataacccatccacagcactcatcagatgttatcataattattggtttactatgtaattctcttgttagactcagaatttcttgaaaatgatgaacaggatttgtatgctcagcccatagtacatattcagttaatatatttttgaattgaaacactgttttatctgcttattcaaaaggggaaaatttaatttattaacacttactgagtacttgctactctttactctgaaataaaaagagggatgaatcaaaagtccctgtccttgaggaaggtatgatttactgggaataaacatgtattaatagttatattgtactctagctggataattgctacatgatagaagtgtgaacattcttttgtgaaatgacttatagattgcttaaacta

SEQ ID NO: 23681 - DNA, 890 bp, Homo sapiens
gcagcagcaaaggtgcaatgtcctctctagactttactcatctatgttctctttctttgcactgtaaatattctgcaccgtttcatagacaaactccagatcttctggataccggatctctagctctgcgtttgggatgtagtgagtgccagtaaactctgagaaatagcgtcccacgtcagggtgtgagatttcttgaggctccacgttatattccaagttttctgttggtaaagaggcacacgggcattctcattacaatgtccattgctgccacacctttcatccagagaacctcccatcaccccttccaggtggcatttttggggtggagaagggaagactgaagatgtttatggagtcaggagagggtaatgggaaaagggcagcaagtggcaatcaggagaaggtgggtggtggcacgggtgtctcaagagctccccacggaacagcaggatcttcctcatctctaagcaggatgtctggctccagcaaaactccaaaggtctcttggggactggcaaactagagactcaacaggtctctctgactggacaatgggacaayattatccctgcctgctctttttttggcagtggctaagtttctgaagctgccatgtcacatggtgacaagtctcgtacctgccacccctctcctctattcacaggagcccctcatgcagaccacactttccacccgagctccttccaacactggcccttagcttccaacagagagcagcctctttccagggctgctgtgagaccgtgggatgaaaggaaggtggcttgcacctccagaccccatgtggatatcagatgttattatctgtaccatctcttgggaaaaccatgctacctcttctctctgttctctattttgccact

SEQ ID NO: 23682 - DNA, 498 bp, Homo sapiens
agccgggtcagacagagcagagtggtgctggtggcaaggagaacagagggagaagcacagcggggaggacacctggggatctggggtgccagattgggtccagggggttataacagagaagagagaatttaacagggagagcagaggaggcgcrtagatgggagaagaggcagaaatctatggagattgaggacgatctaaagattggggagaaggaccaacaggaggttaaataagttgcaaggatggagcccagctaatttttgtatttctagtagagatagggtttcaccatgttggccaggttggtctcaaactcctgacctcagataatccacccacctccacctcccaaagtgctggaattacaggtgtgaaccacctcagctgtccacccatgtatttcttgattgaaataatttgcttatgtcttggytctacagctgaccctgtttccctgttttcaaggtcaagagctgtgtgtttacactgctgcat

SEQ ID NO: 23683 - DNA, 807 bp, Homo sapiens
gcaccgttaatacatatatactaattctggtttacaacagcaagcgtgagaattcaggtggttccaggtctttgtgtgcatctgtttgacttcagaatccaaggcctgtgtaccagcaccttctctccaggtctgcttccaattcgcagttgttagaattttggagtagctgttactaaagattatacwywkmakrkattttaagtgtcctggttaagagaggcatttactgttagctgcatttggtacttaagagaggtaacttgaaatgtcttaagagtcttagaatgcttaatgttttttttcttgcccatatgacagttgaacattttgcatattcgttaatgggattttttggtctgttttggctgctataagataatgctatagactcagtgacttataaacaacagaagtttatttctctcagttctggagggtgggaagtccaaggcactggcaaattcgatgtctggtaagggcctgctttgtggttcataggtggctgtcttctagctttgtccttatgtggtagaaggggtgaaggcgtctctggggtttcttatatgaggtcactaatcccatttgtgatggctctgccctcataacttaatcacctcccaaaggccgcactttcaaataccgtctcgtgggcggagggcgtattgggattttaatacatgaattttaggagatggaaacattttagtccataacatacaatgataatactaatttatgtgatttaataaaagcttattctcttaaatcttggaacaagatttgtattaaattattctcctaatt

SEQ ID NO: 23684 - DNA, 557 bp, Homo sapiens
  misc_feature 433: n = A,T,C or G
gtgatttattttctctatagatgtcaacaagatacacttgccttgtatggcaaaaataaattaattttagctttgtgcagatacatcctattgagttacaaagtgatgctatcaaacaccattgacaacaacaaattcaggatttatggctttctttgtctctgtttctctctccttctctctctctctctctctctctctgtgtatatatacatatatgtatattatacatatatagtttaagatacatgtgtatttatatataattttattttttagaacaaaattaaacataaagtgtctttaaatgaaagtctgtgtttgtaacacaatcttatgacatcagcattaaaaaggctattcagaacacttcctcaaattgaaactattaccaatactgagttaaatattttaggactacttcattatctangaaatttgagaagcaaattaactctttgctcagagtattgtgataccatatcttttcttgtaaaataagatattgtttaattataaaatattgtcaaatttctgaaaaagtgtttatataagtg

SEQ ID NO: 23685 - DNA, 489 bp, Homo sapiens
  misc_feature 66: n = A,T,C or G
cctggctgctgtgtcccgcggcttgcgctccgtagtggactccgcgggccttcggcaggaatctanaaaactgtatctgaagttgttcctacctgaagccgttgcattgagaggtgctaagtggatcctctggccagctgactgcacttcttttttgagaaaggaaggaatatatcctgactgattgtaagtagcataacttccaagatttcctagtgacatatcataaagtttcacagtcagaaggtgaatattttaggcacagtagaataacattgaatactaccccattacttctaaatactatttttcagcatctactatgttttaggcactgagctgcacttgttacagatattcttattccatccatacaacagcccgcttagatcatattagtatccatatcgtgtggctctccaatgttgagtaacttgcctaacttctcacagttagtaagagactgagctggggtctgaactcaaggcc

SEQ ID NO: 23686 - DNA, 590 bp, Homo sapiens
  misc_feature 191, 332: n = A,T,C or G
gacagagggggactggaacttgggcacaagccttttttatttcacagaaggcctccgaaagtggatggtgcaacacggtggggacggctgggtggtggaggaaaacaggacaaccgtgcctggggccccttctcaaacgtgcttcgtgacttcattcagctggtgttgcaagaaacaggtcttggacctanaggaggagggtctgtggccagaactgctggatagtggcaggattgagatttgtgtctctgactggtggggagcccgacacgacagcggctgtatgtacagactcctcgtccaacttctagacgccaaccagactgttctanataaattctctgctgtgcctgatcccatcccgcagtggaacaacaatgcctgccttcacagacacagtttcactatgttgcctgggcgatggagcgagactctgtctcaaaacaaacgtacaaaaaaggaatgaaatactgatatatgctgcaatatggatgaaccttgaaaacatgctaaatgaaagaaggccacatattttatgaatccatttatatgaattgcccagaatcggaaaatctgtggagacaggaaat

SEQ ID NO: 23687 - DNA, 578 bp, Homo sapiens
acagaagggacttaaaattggtttcatccatgacatcttcatttgacaccatattgtttgactgtttctggaatattaccttttctgccattgtttatatactctaagactttgaaatgacaatttattaagcaatggtataaaaaacctgagcgtagtggttgcattttttgagcaagatggagatgttaatacttttctaaaaagttgtttttctcaattcctccacttccttaaatccctgatttcaagtttctattgcatcattttaacagccttttcagttcctccacattagctgctgaagtaggaaaccttaaacaagagattccttagctgtgttctacaataatagccaaattccaaccctatgatttattatcttcaaaggctgtaatctactaaatttcagagatctgataaaattacattaatatatacaaatacatgcatatgcatatataaaaggaagaatattgaatcattctgtggttgcaataaaatttaaatcttttaagattcacattgtatatttgaatagtgcttttggaaatcaccaattttactggatatttgga

SEQ ID NO: 23688 - DNA, 504 bp, Homo sapiens
gacagaagggtgctatttgtttgaagaacttagtttattcttctgtgtacttattttccacatctgcagaactgtgaccatcctccacataatttatagtccataccaagtagtggatcaaacgagctcctgccaggcagtcaccagcttctgatgagaacagcagcatgcagcctgcacttcaatgctgcactcccaagaccagctgtggcccccacactgccagtgctgtgtgtaacgggtgctctgtagtccagtattattgatttcctatagattctttattttttaaatagcccatgtcagtttctctctttaagtgtgggaagggtcctaagctttagtttcctgttctgtaaagagggatgatactctttgccttttttatctaccatgcaattattatgatcaagtgagattatttttgtgaagccatgtaaactataaagtgctttccaagcatgaggaattactgtggatgatcttgagtttcacatggaggtc

SEQ ID NO: 23689 - DNA, 544 bp, Homo sapiens
  misc_feature 223, 388: n = A,T,C or G
ggaaaagcaattaaaaaaaatcagcatctctctctagcctattatctcctgttagacacagcccagaaaatgaatagagacaagtcctggctgggtctgggttcagaaacataatagaaggattcatctaatggaagggaattctttccacagttgctagttcctcacacctctgcctctatgggattctcctggtccccacatgctctgctgtgtcttctanctgtcggccactgtggaggaagtgaaccttctagatcctgctgactcatacaatgagttttgtgtggaccatcagacaaaagggctggctggtgaaggtggctgttgtctggaaattcctcccagctctcctctaattatgtcataaggactggaggccccttancctgcttgtgataacacgcaaggaaatatgggccaactcttcacatgaacacaagatatttccatgctagccttttgcaagtaacaacagaaagagctctgtgcagttttcactggaatgcctgtggattgcttgtgtcataactgtaatctaaag

SEQ ID NO: 23690 - DNA, 573 bp, Homo sapiens
  misc_feature 54: n = A,T,C or G
gagccaattgatagcttatgctgtttcaatgtaaattcgtggtaaataacttangaactgcctcttctttttctttgaaaacctacttataactgttgctaataagaatgtgtattgttcaggacaacttgtctccatacagttgggttgtaaccctcatgcttggcccaaataaactctctacttatatcagtttttcctacacttcttccttttaggtcaacaataccaagaggggttactgtgctgggtaatgtgtaaacttgtgtcttttagaaagataaatttaaagactatcacattgctttttcataaaacaagacaggtctacaattaatttattttgacgcaaattgataggggggccaagtaagccccatatgcttaatgatcagctgatgaataatcatctcctagcaacataactcaatctaatgctaaggtacccacaagatggcaaggctgatcaaagtcgtcatggaatcctgcaaccaaaagccatgggaatttggaagccctcaaatcccattcctaatctgatgagtctatggaccaatttgtggaggacagtag

SEQ ID NO: 23691 - DNA, 584 bp, Homo sapiens
  misc_feature 100: n = A,T,C or G
ggggtctgtcatgtcgtgctgccccttcgcccccatcaagggactgcagtagacgcagttgtattacaaggtggaccaatggctccttctgagggtttangatggctgactagaggagagcgggggtggaggtcctctctccggtggatgaacctgcaagatgaaatagccagaagctaggctgggcatggttgtttacgcctgtaatctcagaactttgggaaaccgagatctcgatgggataaccacattggtttgtttagtaaacactgagaccaactccaccatccagaggcctgacagacaaatggcctgagacagggctgggaaagttttgcttctggttgggacttcaggaagagttttgttttgttttgttttcccccaagggaacaagcccttgaatccgggaggccaaggttgcggtgaaccgagattgcgccattgcactccagcctgggcaacaagagtgaaactccgtctcaaaaacataaaaagtaaaaaagatgtgtacgtcaatgtcagactttctgtgctggatggaaggactctgagcctaccaaaggaagcgtatttacaaacct

SEQ ID NO: 23692 - DNA, 577 bp, Homo sapiens
cccaacactttgggaggcctaggcgggaggatcacttgagcccaggaatctgaagctgcagtgagcctttgctcgtgagattgtggacctatgatcctaccaccagcccacctggttctaacaccccctcctctatgtgtgagagggagagaagaaaagtgagggagaaaagagagataagcaaagaacagagaggaaaaatggaaaataagaggaaattgggggaattaaacagaggggagggcatggatccccgggagttagaagagtagcagcttgtggattactatgcagtggaggaagaagagttgttggaaattatttgagaggtagtataatcatttgtgaggcagttttctgcattcaccatttctcacagactaagttactcataagcaaacgtgcaattcacattacactgaaattcttccctaatacatcatttgcattggaataaagtacggttttcaaacaacctgatatagcagaactgactgtataaattatgtgagcacagtgcaagtaattctttgtttgtttgtttgtttttttgagacagagtctcactctatctccc

SEQ ID NO: 23693 - DNA, 615 bp, Homo sapiens
acagaagggctaagaactttgcacataatcatacaatcttttgaaaatattttgcaaatatgtgtttagacaataagatggactagagttcgacaaaatgatttctttatttaaattttgtataagtattttcttcgacactttcaaattatattgtgttcttgatacatgctgtatatttatttgttagtgcatgtgtttttaatttacatgaaaacatgagttaggagaaattacaggttgaaagatgaaatgcctgtatgtgctctgaagaaatggtaattccagattgtgcagggggaaacaaatctattttgttttgttttgttttttgagacggagtcttgccctgtggctgggctggagtgcaatggcgcgatcttggctcactgcaacctccgcctcccgggttcaggggattctcctgcctcagcctcctgagtagctgggactacaagcatgcaccaccacgcccagctaatttttgtagttttagtagagatggggtttcaccatgttggccagatgatctgaatctcttgacctcgtgatccgcccaccttggcctccacaagtgctgggattacaggtgtgagccaccacacccggcctata

SEQ ID NO: 23694 - DNA, 548 bp, Homo sapiens
aaagaaatccagtgcatgtttggggaaccacagggaatccatggtgggtacataagaagagttttaggtgaggataacataaaaaaggaacataaaaaggtctgtatgtcattaatctgaataatggcggcaaatgtcaccatttaattcagtaattcttgcggacatctgtaaaggaattatatagcacgggacaataattaacatggagatgattaatcaagggacatggcggctcaagcctgtaatcccagcactttgggaggccagggcaggtggatcacttgaggtcaggagttcgagaccagcctgggcaagatgttaaaacccatctctacaaaaaatacaaaaattagccaggtgtggtggtgcatacctatagtcccagctacttgggaggctgagatgggaggatcacctaagcccggggaggtcaaggctgcagtgagccatgattgtgccactgcactccaacctgggtgacaaataaacaaaatgattaatgatgatgatctcagattatcaaggaaaggttaaataaactattt

SEQ ID NO: 23695 - DNA, 625 bp, Homo sapiens
acagaagggcgactagctgccttgcacattatcttcattttcctggaatttgatacagagagcaatttatagccaattgatagcttatgctgtttcaatgtaaattcgtggtaaataacttaagaactgcctcttctttttctttgaaaacctacttataactgttgctaataagaatgtgtattgttcaggacaacttgtctccatacagttgggttgtaaccctcatgcttggcccaaataaactctctacttatatcagtttttcctacacttcttccttttaggtcaacaataccaagaggggttactgtgctgggtaatgtgtaaacttgtgtcttgtttaaaaagataaatttaaagactatcacattgctttttcataaaacaagacaggtctacaattaatttattttgacgcaaattgataggggggccaagtaagccccatatgcttaatgatcagctgatgaataatcatctcctagcaacataactcaatctaatgctaaggtacccacaagatggcaaggctgatcaaagtcgtcatggaatcctgcaaccaaaagccatgggaatttggaagccctcaaatcccattcctaatctgatgagtctatggacc

SEQ ID NO: 23696 - DNA, 533 bp, Homo sapiens
gagggggactttcagtggatctatgctcagagtcatggagaaataagagatcctaagatgttttaaactactataatgatctagagttatatgtttgctgctttggaatattaactgttctctagttttcgttattagaatactttatattttttcaacctttatctgaaatttaggcacatttgtaacaacaatgtacttccaagattttccttactggtaaactaataggtaaatttaaatttagtcttcttttcatagttagcattctatcgtatgttgatggaaagtcatttgtatagtgtttaagtttttcagtgttcttgatctttctgagactgtaggtagacagacctcattttcattttacagagaagaatagaaagcctagagtgacttgcttagcttcactatacatagtggcatgggtcttccaagtccatcattctactctatatcctgaatgtggccagaaattttctcacattgttagccttaaaacacagtttcagacctgttggtaacatcactgg

SEQ ID NO: 23697 - DNA, 565 bp, Homo sapiens
gacagagggggtggctcacacctgtaatcctcacactttgggaggcacaggcaggaggggctgggctagggtaacccacctaggccaggcgtctgtcctagcatcctcccccaaaaggaatgtttcctatttacccacacatcctgaccctcccctctcccactatagtcagggcgtcttcccagttcttggttcacatcccttgtgctaaagtttgggccagggctggcatacctgttccacatggtacaaaacatacatggtatcacctgtgattgattggtgtggtctgcctggagcactgtgtggaaaaggatttaaagaacatgccaggtgccatgatcagttaacactgttccaggtatgggaggtggaaacaagactgtgagagccacacattggctatccttaggtgaatctaggaagtgtgtgcttatataaagatgtagatgccgaggctcaggatggaatttggggatccctgtgtctcattcatgatggagatggggtggaggatgaaaaccaaatcctctgggtgttccaggcaggtggatcacttgagctc

SEQ ID NO: 23698 - DNA, 195 bp, Homo sapiens
cattctcctccgcataagcctgcgtcagattaaaacactgaactgacaattaacagcccaatatctacaatcaaccaacaagtcattattaccctcactgtcaacccaacacaggcatgcccaaaaaaaaaaaaaaaaaaaaaaacccctgggggccgttttttccgtaaacccaaccttgaaaaaacccttggg

SEQ ID NO: 23699 - DNA, 536 bp, Homo sapiens
gggtagatagtaatgaagttttagtatcttaacagcaattatgaataaagatatagaaaactgtttttcactagagtgatattacatttgttaatcttagaaattgactatttgagatttttctaatcaaattaaaatggaaagtgtaatcttgctaatgttctttaaattacctctattgattgtctcttcttatatccagatgaaaagatcatcagctatatatgatctagttaaagtcacttttaaggactgatataaattattgattttttcaaaaataaaaaagtagaccaatgtggtcttcagaaataaaaaaaaattacttgcttttaaaacattattaaaggcttgacagtcaaatggatggtacttagattaaaagaggtttttaaagacatggcaaatagtagtgtgcacatctgatacaaatcctgattcaaacaagttttaataaaaacaagacaatgcaaaatttgaacactgactacatatttgatgatttaaggaattattgaagtgtatgtatggtaatg

SEQ ID NO: 23700 - DNA, 500 bp, Homo sapiens
acagaagggtggacaggtaatgccagatttccccacccccctttctaataacagtgaatgacctgagaagtaattgtgtccatttagaatttcattagattacgatggaaatgaaggtagaaatgaagaatcaacatgtggaaaaaatatgtctgtaactaggaattgatgtactgagtttttctgtccttgttgatttattattcccttgatggcatttttgagaccaattatttcaacatgtggtgaatctttttattcatctgtctctctgtatctggaacaagtatatcttggatatacctgagcctataaaacttggtgttaaccagactttcctctctatggtgtaaactgccatagttggcaagaaatattccagggaaagcaatgtaaattttctcaaatgagaaagatgcgtgggtttatttaggataaaaagcagagacataaatgctacaaacatatatggtattagaatgattattacatttatccta

SEQ ID NO: 23701 - DNA, 670 bp, Homo sapiens
ggtctgcagcttcactgctgaagccggcgagaccacgagcccaccaggaggaaggaacaactccagacgcgctgccttaatagctgtaatactcaccgctgaggtctgcagcttcactcctgagccagcgagaccacaaacccaccagaaggaagaaactccgaacacatctgaacatcagaaggaacaaactctggacacgccgcctttaagaactgtaacactcactgcgagggtccgcggcttcattcttgaagtcagtgagatcaagaactcaccaattacggacacagtatcagccttttcaccagtaccccaaggcccaattcccacagggcaacagggacaagcccagatagacagctacacataaaattgattgtgtaatagtagagaaaccctaaagttagggaaccctaatcttttatactgaatagtaagcatgcctgctgtttgctccacaaagagacatcatctctttcaaggctgttctataaaaatccttgaaaaaatagtctgtaataaaggaaatcagtgcctcacttgcaagatgtgcagatatgcaagagatcaatggaaaattatcttccagcacttccatattctgaaatcaagaaagatgttcatagtttcatcatacgctaaaacatataattatgcctgatagaaa

SEQ ID NO: 23702 - DNA, 542 bp, Homo sapiens
  misc_feature 189, 360, 393: n = A,T,C or G
tcgtgtgtgtgctttctcttcaactcctgtcctttttgtcttcttcacagatggcagaagattttcaagtcccggctggtggagttgttagtgtcctatggcaacaccttctttgtggttctcattgtcatccttgtgctgttggtcatcggtgagtgagctatggctgagggcagctacctgacctanaccctggtctctgctgcaaaaccctttgccacttttgatgtgtagcatccagttttggctgctaggagacagaccaatgaaatgctgtgtctttctcttgagggagggaagaggctccctttgcccatgctgctgaccgctagtcggttcttcactttgaggcccctctangccgtacatggtggctcatgcctgtaatcccancactttgggaggctgaggtcggtggatcacctgagatgaggagttcgagatcagcctggccaacgtggtgaaaccccatctctacgaaaaatacaaaattagctgggcgtggtggcgggcacctgtaatcccagctacttgggagactg

SEQ ID NO: 23703 - DNA, 621 bp, Homo sapiens
  misc_feature 143: n = A,T,C or G
acagaagggctggcagtcaaataatctcttgcagagatataggagtgaatgagctctcaaggaatgggacaacaggtagacagtgtacgtattaacgtaaaggtcctgactgcgatgggatctgaggtggacattgtccctantagctgaaaccatgggctatgaatgattttgctaaggatctcacaacctgccggagtcaccagtggagacttctttaaactacagcccagatacctgaaaggtaactttggaatcatctcacctagggaagcctgctcctacacctgcctggcgctgcccgggcatagcctatcttttctccacacttctacaaagcaactacctacagaatgagcagataaagtataaatgtctctactggcaggttgttcatgtgtctgtggctgtggaggctgaaaactactggaatgagtttgagaatccacaaaacagaggcaaggactgattctgaaaacacttcttttggccgggcgccgtggctcccgcctgcaatcccagcactttgacaggccgcggcgggcagatcacgaagtcaagaaatcgagaccatcctggctgacaaggtgaaaccccgtctctactaaaaatacaaaaaaa

SEQ ID NO: 23704 - DNA, 455 bp, Homo sapiens
  misc_feature 49, 336, 378: n = A,T,C or G
gatttgaaactggccccctgactccagagcccacactgctaatgtctantatactgctcccctggctgacataatagaagtgaactttggggtgtgaatgtacctacccctggggactgtgatggctgaaacaatggaaagcacatggcatttgactcacatgcagttcctgctgctcccaacaatgccatccatgtgtgttagtaaaggatagagagctggagagaagggtataggtataggaccaggtgtgccatgtcatcaccctaacgtacctaaccctaaccccaaccctaaccctcagaggcagtgatggcctacaggcacctgcattanggtggtttggaggatccatgttcattgcaaaccctcccctanggagggggttccctgacactcaacatctggatctgcccatggcagatcgagccactacggtgtcttgcctatacccc

SEQ ID NO: 23705 - DNA, 558 bp, Homo sapiens
gtattgtactattataatgaggattatggaaaattccactgcatttgtggcagatgaatgtaaaatagcataggaatccagataatttgaagatatatgagtcctgcattttggagctggccaaaagtttgattatttgccagaaacctgtgagtgggcgtagcatttaaacagggacctttattccaaagtagccctggtttaatctggcatgttggcgaaagtacatactacacatacatctgtgtatgttaatttcttctaatctcatattttctatttagtcttttaataattccctaaaataactatttcagttgatatttactcagtggcctaacttgaatcctatgactctttctctgccataccatgaaggcggttagttttgtctattttgtttactactctatcccaattatctagcacaaaacctcacattacaagaccttagtaactgattgttgaatgaattaatcagttccacacccttcctagtccccactcttcagttgtttattcattgaacgaaagtttattgaaaacctattattggct

SEQ ID NO: 23706 - DNA, 415 bp, Homo sapiens
cttgctgctgctcactctttgggtctgcaccacctttatgagctgtaacactcactgtgaaggtctgcaacttcactcctgaggccagtgagaccatgaacccacctggagggattaacaactccagacgggaggaatgaacaactccagatgcaccgccttaagagctgtaacactcactgcgaaggtctgcagcttcactcctgaagccagcaagaccacgaacccaccagaaggaataaactccgagcatgtccgaacatcagaaggaacaaagtctggacacaccatctttaagaactgtaacgctcaccgtgagggtccgcagcttcattcttgaagtcagtgagaccaagaacccaccaatttaggacacactatgtgttaggcctggctcagtaagtataaagaatat

SEQ ID NO: 23707 - DNA, 557 bp, Homo sapiens
ctctttgcaataaatcttgctgctgctcactctttgggtccacactgcctttatgagctgtaacactcactgcgaaggtctgcagcttcactcctgaagccagcgagcccacgagcccaccgggaggaacgaacaactccagacgtgccgccttaagagctgtaacactcatcgcaaaggtctgaagcttcactcctgagccagcgagaccacgaacccaccagaaggaagaaactccgaacacattcgaacatcagaaggaacaaactccgggcatgccacctttaagacctgtaacactcaccacgagggtccgcggcttcattcttgaagtcagtgagaccaagaacccaccaattccggacacaaaaatatatgaagcaggctgggcgcggtggctcatgcctgtaatcctaacactttgggaggctgaggcgggcggatcatgaggtcaggagattcagaccatcgtggctaacgcggtgaaaccccgtctctactaaaaacacaaaaaattagccgggcgtggtggcgggcgcctgtagtcccagcgactc

SEQ ID NO: 23708 - DNA, 550 bp, Homo sapiens
cacccagcagctcacccccagctctcggggactcttctgtgtctcccagctcctccccagacaaaccagatttctgacccagtcagcctgccgcacccacgaagccgagagacacttacagacctcactggcatcctcccctatgtctcccatctcatcacccccagccccatgctcttaacactgaactatctatgtctcatatatacagcagcaaaacaaaaccagagaaagtggaaagcagataatacagaaaaaacagaggtgaatgaaatgaaaaatataattttctgggaatatatagagaacgcaaatatatttaacaagcagtataaatgctaaataaaactacaacctcagaagaaaccttaggttaatccccaaataggaaatctattctgaatgctctaagagggaaataacaccaaccttcaatgaggtgattattacaataaacttttccagagagcagaacgcgctaggagcctcttattatattactaccacaaatcctagtataattttgataaccaaattataccataataga

SEQ ID NO: 23709 - DNA, 603 bp, Homo sapiens
  misc_feature 539: n = A,T,C or G
gggtggttataaaatccgcatctttgaaaacattgtgtgctggtctgatctatgtagaaatttcctgaggttaggggatgagctaaagatgcttagtaatggtttccttctaaaggttttggatgtcacaaacctcgcataggttgttccttttagagaacgaaagtaaaatgagcacatactcattagctgttcaacgttggtgctgatctgtgctatcagagcttctctgtgctgctgggctcgctcttctagggccctgcccataaagtagtgttgcagtcgttcttgagcttgggcatggagctccctactgaccacatctgacattggagagccctggaaacacaggacagaaaaacctgtcacagagaggacataggtatcaaagtacccaaccacttagcagaggctttagactgcttagctgtctctcattttatcaattgaatcttatgattgatgtctatcttgtactcttatgcaagtattaattagtctcttaaaagttttagataaaaataatggtggagaagttntttgtctttcttttttgtatgtgcctatactttactttctcagacactgtggaattatgggaga

SEQ ID NO: 23710 - DNA, 489 bp, Homo sapiens
gacagaagggagggacctaaacgggcggtgcccttacccactggtccctccctgcctggtgtcttcggagccctagctcacccggaacgttactgcccgccggtggcagcgagaggaccaaagagggcagcgggtgcggtgggaaccacagagtcaccgcgcacctgcgcctcgcaggctcctcgcaaattgaataaacgccccctgaagcttctcttcaagtcacagggaaggggaaggtggctgccgacccggcgggagaagccagccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatcccgcctttatcaggagattcctttgtcaaagttcagagacctggggttcccgctgcttgccacacaga

SEQ ID NO: 23711 - DNA, 397 bp, Homo sapiens
gagttggtcggcactatctaataacatttctttccttctgcaaacctaggatgcattcacagaacagctgaatcagtgaggccaggagaacccacccctgccccagttgggttccagcgcccccaccagtgtgcagcagagcctcaccgtggacctggtgtgccaggagacccagcaaatagttgcttgcctgctgcagcaggatgttgttgtcaccttcgtatgtgcagttgggatcgttgtcatctctaaggacacccaaccggttcactgcaacaaagccacaatagtaccatcatttaagacgcatatttgagaagcagcctgtctctatgtgagaatttaaaaagccttaagaggctgggtgcggtggctcacacctgtaatggcagcactt

SEQ ID NO: 23712 - DNA, 491 bp, Homo sapiens
gagggtctgatgttcggatgtgtttggagtttcttccttctggtgggttcgtggtctcgctggctcaggcgtgaagctgcagaccttcgcggtgagcgttacagctcttaaggcggcgcgtctggagttgttcattcctcccggtgggttcgtagtctcgctggcttcaggagtgaagctgcggtgagtgttacagctcataaaggcagtgtggacccaaagagtgagcaatagcaagatttattgcaaacagcgaaagaacaaagcttccacagtatggaaggggacccaagcgggttgccactgctggctcgggcagcctgctttttatttctctatgtggccccacccacatcctgctgattggtccattttacaaagagctagttggtctgttttacagagagctgattggtccatgttgacagggtgctgattggtgcatttacaatccctgaactagacacaaaagttctccacctccccactag

SEQ ID NO: 23713 - DNA, 413 bp, Homo sapiens
gacagaggggaaggaaaccgcggcgctggggatggagagggggaaagtgaagaagaaagagaaggaaaaggagacgcagaaggagaaaatcggagaaaagggtagggaagagaaagtgaaaagaaaggaggtggagcagaaaattaaacaaaagcaagagaagcaggagaggagaaagggaaaagagaaagaggaaaagaggacaaagcaagggaaggagacaaacaaagagaaggaacaatttaagggacaagaagagaaaggggagaacaaggacagcaccttgacaaggaccccgctcgagccgctggagaaaaacaagcaaatcctagtgctgggcctggatggagcaggaaaaaccagtgtcctgcactctctagcttcaaacagagtccagcacagtgtggcaccca

SEQ ID NO: 23714 - DNA, 487 bp, Homo sapiens
ctacagaattaagttagcagtaaggtgataatacctggcatagtatggtggctgagtaaggaaaggatataagtcatttcaaagaattaggcctggttactgacaatagggcatgaacaaaagggatgaattcaagatggctttaagcctgcttggaagatgtaggtgacattggcagcgaggcaaatcagtgttaggtctcagcttctaattcgagtggccctattaatctagggagtacactctagggaaggtggtatgtggtagaatagaggctttggaattggacaacataggctttagaattggacagaaatggtttccaatccattggctgtgtgattgagcaaactgcttaatttccctgagccttatttactaatgtgtaaaatgagaacttaatgagatgagatttcattatttctctccaagaaagagttaactgcctggtgcggtggctcatgcctgtaatcgcagcactttggga

SEQ ID NO: 23715 - DNA, 626 bp, Homo sapiens
acagaaggggagaaggtctgcagcttcactcctgagccagcaagaccacgaacccaccagaaggaagaaactccgtacacatccgaatatcagaaggaacgaactcctgaaacgtcgcctttaagaactataacactcactgcgagggtccgtggcttcattcttgaagtcagtgagaccaagaacccaccagacacactaagactaggtaatttataaagggaagaggtttaattgactcacacttccacatcgctggggagacctcacaatcatggtaaaaggtgaatgaggagcaaagtcctgtcttacatggtggcagggaagagagcttgtacagcgagctctcatttgtaaaagcctcagatcttatgagacttactcactaccaggagaacagtatgggagaaaccacccccatgattcagttatctgcatgtggccccgtccttgccatgtggggattattacaattcaaggtgagatttggctggggacacagccaaaccatattaactaatgcactgcatgagtctgtacctcctttgaggtctaaaaattaagcaactttctcagggttatacaactggaacgtattctcagtctctctatgcttcccaattatc

SEQ ID NO: 23716 - DNA, 509 bp, Homo sapiens
  misc_feature 453: n = A,T,C or G
gcctcccaagtagcgggattacaggtgtgagccactgtgtctgacaagaatttatacttaagcataggagatggttctggaaattctaagaaattctgctctcagtaagagtagaggtttggagctttacctcttggcagtatcccttggaagggagccctgagattaaatgtaatcaaacacttattgagagctttctatggaccaggcactacactagacgctgggaattacagaggcaattacctgtcctatactcaaggtgttaatgatctagtgtcatttttctttaaaaaagaaagcacctgcatttgtcatcttgagcaaatatagtaactctaacctcaaggttcaagtgatttactcaaggtttaaatcatagttgttttggagaaagtaagtgtcagatgcactgtggctgtcagggtcatagtaggcattaaatcaacatgngttggtgttcattaaatgtggattgaagataaaatgactgatcttaagtttcatga

SEQ ID NO: 23717 - DNA, 495 bp, Homo sapiens
gagagagggcgcgccaccttaacggctgtaacactcaccgtgaaggtctgaagcttcactcctgaagctagcgagaccacgaacccaccggaaggaacgaacaactccagacgcgccaccttaacggctgtaacactcaccgtgaaggtctgaagcttcactcctgaagctagcgagaccacgaacccaccggaaggaacgaacaactccagacgcgccaccttaacagctgtaacactcaccacgaaggtctgcagcttcactcctgaagccagcgagaccatgaacccaccagaaggaagaaactccgaacgcatctgaacatcagaaggaacaaactccggacacgccgcctttaagaactgtaacactcaccgtgagggtgcgcagcctcattcttgaagtcagtgagaccaagaacccaccaattccggacgcactgggaggcggaggttgaagtgagccgagatcgcgccattgtacaccaggatgggc

SEQ ID NO: 23718 - DNA, 529 bp, Homo sapiens
acagaagggtggacaggtaatgccagatttcccsrccymcsytkckarwaacaswgaagkgacctgagaagtaattgtgtccatttagaatttcattagattacgatggaaatgaaggtagaaatgaagaatcaacatgtggaaaaaawatgtctgtaactaggaattgatgtactgagtttttctgtccwtgttgatttattattcccttgatggcatttttgagaccaattatttcaacatgtggtgaatctttttattcatctgtctctctgtatctggaacaagtatatcttggatatacctgagsctmtaaaacttggtgttaaccagactttcctctctatggtgtaaactgccatagttggcaagaaatattccagggaaagcaatgtaaattttctcaaatgagaaagatgcgtgggtttatttaggataaaaagcagagacataaatgctacaaacatatatggtattagaatgattattacatttatcctatcaggttttgaagcagtattattgcctt

SEQ ID NO: 23719 - DNA, 597 bp, Homo sapiens
  misc_feature 415: n = A,T,C or G
ggaggssatctgccagttggtatgaggaggccctgaatgatgacatcagaattctaaatattctggatgtactcgtctcaacttttcctctccagctaccacatcctgagagacccagcagggtggctagccatggacccagacagtgggcaggtcacagctgtgggcaccctcgaccgtgaggatgagcagtttgtgaggaacaacatctatgaagtcatggtcttggccatggacaatggtgagagcatcctcccagccctcccacaagggccacttttggttctcaggtcacatgacacagcacagcatgtttcctccacaggtgggaacatgtgtcgaggagggctatttgcaaaccaatccagacggtcaaaggggtctttcagaggagtcttttaaagactggtcctangcyggatgcagtggctcatgcctgtaatcccagcactttgggaggccaaggcaggtagatcacctgaggtcgggggttcgagaccagcctggccaacatggtgaaaccccgtctctactaaagatacaaaaaattagccgggtgtggtggtgtgcacctgtagtcccagctactccggatgc

SEQ ID NO: 23720 - DNA, 611 bp, Homo sapiens
  misc_feature 505: n = A,T,C or G
acagaagggtggtggcttgtgtgagtcaggctccttcagttgcacagtacaagatcaaaactcaaacttgtttaggcacataaagggagtttaggtgtttcatctgtttgggatcctgtaataaaatatcacagactgataccttgtaaatagcaatttatttctcacagttttgaaggctggaaagtccaagatcaaggcaccaacagatttggtgtctggtgagggcttgcttcctggtttgtagatggctgtcttttcactaaccttatatggtagaaaaagactagctagctgtctagggtctctcataaaattactaatcccattcatgagtgtgtaaccctaatgacttaatcatctcccaaaggtcccaccttctaataccatcgccttagtgattaggttttaacatatgaattttgagggtgaggaggacaagcacattcagaccatagcaattgccttaataaagtaggagctccctaagtacccctggctttangcatgtttgtaactaaaggttgacacaacatccatttctttctgctctttgacctcattttctctatgtgggctttcttctccagcagaacgaccctaccgactgc

SEQ ID NO: 23721 - DNA, 686 bp, Homo sapiens
gcgggaattggagactgtagtgygctgccatcatgcctgtgtatagcttctgcgctacagcctgggcaacgtagcgagaaccatctcagaaaaaaaaaaaaaaaaarraratattctwttcctcataaattcactaaaactggaaatatttgaccggacttggcagcttttggggggaaggacgtaaaaaatattttttaactgcctaccttattttaataatcataatttgttaagccagctggcctattttcttttttttctggaaaattattttccactgagttaaattttttgaaaaagttacacagaattctttggbcattctttatatctccctttttgaagttatgtcccttaatttctgaaactttctgaaaccagggttaatttgttttaaaattgtccaacgggggctttgaaaaaaaaaagggatgttttytgkgtcaaatgaaggtaatcataratmaaatttgcttattgtcttgttcaaatcctagaaaaccattagcatttttctttgcttgtaatatgagaatctaacactcatacagaatattgaaaggttaccctacaattgtaaatttgaaattctccttctaattctgtcagttatttattgacatagtagtggttctgtagtcaagtgcatataaggttttgaatgttacatcttatttttggat

SEQ ID NO: 23722 - DNA, 601 bp, Homo sapiens
agacgacagaagggtacggctgcgagaagacgacagaagggttttgctgcgagaagacgacagaagggtacggctgcgagaagacgacagaagggtacggctgcgagaagacgacagaagggtacggctgcgagaagacgacagaagggkasksmtgcgagwagmckwcagaakrktackgctgckwkmagaskamwgaarkstmcrgctctgcsagaagwckwywgawgksatggagaaaaaaccaaaacaacttaattcctgcccatccagggcttatctttgaagtaataagaggagaatgaaagacttgaagaaaagagtggcacttggatacatttccacccacacaggtacttgttttgttttgactttktgtggwctgtttgtgtgcttgcagtgtatttttttggaaaggttgtgtctttgagttcaaaagaatttcctttccgtatttgattcarcttccgtatttggttaccactgcagttgtgacagttgcttgactaatttttgcaatgcccagggctcattgagattcttggaaaggtgaaaagccaccgcatttactctctccagtgctgactctctttctgctata

SEQ ID NO: 23723 - DNA, 685 bp, Homo sapiens
  misc_feature 133: n = A,T,C or G
acagaagggggccacgctgtgtcagagaatggtgcctcagtggaggaccccatgaacatctccatcatcgtgaccgaccagaatgaccacaagcccaagtttacccaggacaccttccgagggagtgtcttanagggagtcctaccaggtaagaagactgggaaggggactgctacggggctgggcccacacccttaaatgctaaaagatcccaccatacctgatttccttggctgtgtatcagattacttgggatcttcttaaaaatccagatttccccccttccatcccaaggttcctgaataagaatgatcctagagcagagctctggaatctgtatatttgaaattttccctaaagcttcagatgatcagccaagcttgggaaccactagctttggagcttcaaagacctagatttgaatcttggctttgccctctttaccggctgtgatcctgggcatattcttgacctctgagcctcacttctcacatctaaaaatgggaataatatcaactttgaagagtggtgaagattagaaataccatgtgcagrctgttaggtaatacagagcgcctaatgcgaatctcttgagagcatggcagccacagggaatgcagcaaagactggagtgttagaacatggctgatggaggctgggcgcggtggcccacgcctggaaccct

SEQ ID NO: 23724 - DNA, 561 bp, Homo sapiens
caccatctatatcaaatatagatgattctcttgagtagtaaaagagtacaagcatattcaatgctatttcttaggaaccgttaattaatctttcaacaatcaattcaatcatgattacaacagctttgatgagcactagtgctacagcaactgagacagcaaccaagaggcaagaaacctgggattggttttcatggtgtttctaccatcagagtcaaagaatcatcttcacacaacaacacaaatggctggtaatgagttattattatctcatagcgtatgttttcttgacagccttgaataattttgattgacctctgggatgttattaaagcctaacgttccttctattctcacaaattttcgttatgacttcagaaggatcattaactctggtatctgtttgtttgcttgtatggcaccaataagcagatttcttctttctaatctatggattagtatagaccgggagaaggctaatacagagactatgaaacgggaataagtttttttaacgatatggcaaaattgtgactctgaaagatcattcatgtatattct

SEQ ID NO: 23725 - DNA, 292 bp, Homo sapiens
tacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaaggggasawagrsawagttgtccmwgaatctgctgcgcatraagttwatgcaaaggggactggaywmakaaamywagaaacwackmmaaaaaaaaaaaaaaaaaacc

SEQ ID NO: 23726 - DNA, 525 bp, Homo sapiens
gacagaagggagggacctaaacgggcggtgcccttacccactggtccctccctgcctggtgtcttcggagccctagctcacccggaacgttactgcccgcckgtgrcagcgagaggaccaaagagggcagcgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatcccgcctttatcaggagattcctttgtcaaagttcagagamctggggttcccgctgcttrccacacagaaaaccgatcactgagacggttattgccaaggaagag

SEQ ID NO: 23727 - DNA, 987 bp, Homo sapiens
gcgggcaagacagctggryrkasrgsgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgtgagaaggggtccacaatggcaagaccagggaggggtctgggcagttaggattgtcggggaactgtggttgctgacttccctcttctcctccctacacctcacaggatttcttccgaaccctcatagcggcaatcctctacctgatcacctccattgttgtccttgttgagagaggaaaccactccaaaatcgtcgcaggggtaaaggccatgggagcagctctgaagcacagagcgaagggtttgaggagccagggaccatttctgcctttgcttctggcagaaatcgtgtgacccacagcaagtcacacttgtcctcagacatggaggaaagtctggcccaggacttggttttgcctcccaaggtcttcatttgctgtgaagggaagtcccttgtcagacacaaggaccttggtgagaggtacaaacaggcggcccctttgtcaacgcactagactaccatctgcaagaactttgtcccaaatgtagtagaaattggggccgggcgcagtggctcatgcctgtattcccagcactttgggaggctgaggccgaggcaggcagatcacttgaggtcaggagttcaagaccagcctggccaacatggcgaaaccccatctccactaaaaatacaaaaatcagccgggca

SEQ ID NO: 23728 - DNA, 344 bp, Homo sapiens
ggtgaataaagccttcccagcatctctctctagcctattatctcctgttagacacagcccagaaaatgaatagagacaagtcctggctgggtctgggttcagaaacataatagaaggattcatctaatctgtcggccactgtggaggaagtgaaccttctagatcctgcttttttatacaatgagttttgtgtggaccatcagacaaaagggctggctggtgaaggtggctgttgtctggaaattcctcccagctctcctctaattatgtcataaggactggaggccccttagcctgcttgtgataacacgcaaggaaatatgggccaactcttcacatgaaca

SEQ ID NO: 23729 - DNA, 259 bp, Homo sapiens
gacagaagggcaaattatattgtgttcttgatatatgctgtatatttatttgttagtgcatgtgtttttaatttacatgaaaacatgagttaggagaaattacaggttgaaagatgaaatgcctgtatgtgctctgaagaaatggtatttccagattgtgcagggggaaacaaatctattttgttttggtttgttttttgagacggagtcttgccctgtggctgggctggagtgcaatggcgcgatcttggctcactgc

SEQ ID NO: 23730 - DNA, 303 bp, Homo sapiens
gaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctcttagctccttagtctagaggggtctcctggctccatttgaccctggtctttaataaccggtcagcatcttgctaccttctaccacctttccaaatctctggaaatc

SEQ ID NO: 23731 - DNA, 588 bp, Homo sapiens
  misc_feature 176: n = A,T,C or G
acagagggggacgttgcctgtgggtgcccgcgaaccaacggttagcggtggcaggggctgactgagagcgtctgcttgacagagtctttctctgtcacccaggctggagtacagtggcacgatctcggctccctgcaacgtccgcctcccgagttcaagtgattctcctgcctcanccacccgagtagctgggtctacaggtgtgcgccaccatgcctggctaatttttgtatttttaagaaagacggggtttcaccatgttggccaggctggtctcgaactcctgacctcgtgatccgcctgcctcagcccctcaaagtgctaggattagagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttcc

SEQ ID NO: 23732 - DNA, 537 bp, Homo sapiens
  misc_feature 81: n = A,T,C or G
acagaaggggtagatagtaatgaagttttagtatcttaacagcaattatgaataaagatatagaaaactgtttttcactanagtgatgttacatttgttaatcttagaaattgactatttgagatttttctaatcaaattaaaatggaaagtgtaatcttgctaatgttctttaaattacctctattgattgtctcttcatatatccagatgaaaagatcatcagctatatatgatctagttaaagtcacttttaaggactgatataaattattgattttttcaaaaataaaaaagtagaccaatgtggtcttcagaaataaaaaaaaattacttgcttttaaaacattattaaaggcttgacagtcaaatggatggtacttagattaaaagaggtttttaaagacatggcaaatagtagtgtgcacatctgatacaaatcctgattcaaacaagttttaataaaaacaagacaatgcaaaatttgaacactgactacatatttgatgatttaaggaattattgaagtgtatgtatg

SEQ ID NO: 23733 - DNA, 592 bp, Homo sapiens
  misc_feature 415, 489: n = A,T,C or G
ggaggccatctgccagttggtatgaggaggccctgaatgatgacatcagaattctaaatattctggatgtactcgtctcaacttttcctctccagctaccacatcctgagagacccagcagggtggctagccatggacccagacagtgggcaggtcacagctgtgggcaccctcgaccgtgaggatgagcagtttgtgaggaacaacatctatgaagtcatggtcttgaccatggacaatggtgagagcatcctcccagccctcccacaagggccacttttggttctcaggtcacatgacacagcacagcatgtttcctccacaggtgggaacatgtgtcgaggagggctatttgcaaaccaatccagacggtcaaaggggtctttcagaggagtcttttaaagactggtcctangccggatgcagtggctcatgcctgtaatcccagcactttgggaggccaaggcaggtagatcacctgaggtcggnggttcgagaccagcctggccaacatggtgaaaccccgtctctactaaagatacaaaaaattagccgggtgtggtggtgtgcacctgtagtcccagctactccg

SEQ ID NO: 23734 - DNA, 520 bp, Homo sapiens
  misc_feature 393: n = A,T,C or G
ggagaagtgttgatgggagcccaacgctgaggtcgcccttcccacaacagccaccaggcaccagctggaaacctgtgggcttcacctccatctgtgggcaggaagcaagtggatgtcagggacggtggtggggggctctgcttggaagttttaagaccacactcatcttttgtggccatggacttttcaataccatcctaagtcaagattttttgttgtttgttgttgtttttgttgttgcccatgacagaaaactcacctcaaaatgacttaaggaaagagataaaggagaagaaagatagttaactggctcatgtgattgaagagtacaggggaaacgaccttcaggccaggtgcaagggttaaggtaattttgtttcactctcttcctanggtcctccttcctctgtattagctacactctcagatcctgtcctgcccccagcagctccacagggcttccggttcagaccggaagaacaggagaacagaaggccacgtgcttctcttccaaatgccc

SEQ ID NO: 23735 - DNA, 216 bp, Homo sapiens
agtggccttcctcctttgacctgggccctccccatttgtataggggaaacccttggcccccctttgtacggaagggccgatgcaaacctgcagttaaaaaaggctcacatgctcctaccctcgggcagtcgggaggggaaaccaggacagtgggaaattatgatggcaaagggctttgcttttaaaatcattcggggggggggatcaaaaaaaccc

SEQ ID NO: 23736 - DNA, 569 bp, Homo sapiens
agggggtcactgatctggacgcccccaactcaccagcgtggcgtgccacctaccttatcatgggcggtgacgacggggaccattttaccatcaccacccaccctgagagcaaccagggcatcctgacaaccaggaaggtgagtcagttcgggcctcaaacaatggctatacctggggcagtcaggtctgcagccttcaggatgaggagccactgtctaccgtgggctagtccaggaatcgtaccagcccagtggctcccaacactgttctaccactcttgtgttgggaagtccctttgttcaaactaaatcttacccaggagcccacttcataaataggtaagagtcactgattaattgaaccacatcagtggagcctcctcccagaccacagtgtccaatggctgccccgaatcagtctcacatagagagtccatcttattgaaatccatgttgactttgcatttactctaaaactcatgtctaggtgtttagataataaaatgttttgaatcactgaggcacactcttgcctctcaaaaagtctcttttttgtgtgtatgtattttt

SEQ ID NO: 23737 - DNA, 459 bp, Homo sapiens
ggctcaacccagacaccgactcgcccagggtcttccagctggctgagttggaacctgcattttttaaccacaaggaaaagaagctcagagctaccaagaataatattttattgacttggaatgagttttggaatctgtatttttaacaagctgcccagtgaaaaccatttcctcctcgtcgtggcgcaggttctataggctgcgcccatctctcccacgtcaacagtcctgtgtccttggcgaaggactgttctctcattcagtgcctttcctctcttcctgggccaaatccctgctttgcgtctccctgcagctcataaaaagctgaattacctgaggcagggaaagccccacccactgtcattctcagggaggagtggagtctgcagaggccgcaatgcacagcttccctatccccctccacccgtgttttcccagagcagctctgttccaggcccg

SEQ ID NO: 23738 - DNA, 562 bp, Homo sapiens
gatagaagggcactccccaggcaacctgtggttacagagtggtcagctgggggagaggaggtggagggtgtctgaccctgggctgggaggcaggtgcacttcggtgtcggatggggctcctgccctgatggcatcttctgtgctggtggtgggacgcctagacacttcccaaagaagaggcccctatgaacccagagttgtgaatgtgagggtgttggagagctgccacagctgtggggcccgctgaggggagcagaggaggagggggtgaggagctgacaaaggaggcgcagggcagcagggtggtgcacccaggtgggagcagcaagtgcaccatgcacaggccctggcacacaatagactctcagcacagctgccaaaagaagcattgagattgagctgggcacagaggcttgtatccatcatcccagcacattgggaagccaaggtggacgaatcacttgaggtcagaagaccagcctggccaacgtggtcaacatggtgaaaccccattgctactaaaaaaatatacaaaaattagccgggtgtggtgtcctgtgcc

SEQ ID NO: 23739 - DNA, 467 bp, Homo sapiens
gactactccatccgcactcgcacctgccagggatcctgtgcggctctctccggcctcacgggctgcaccacccgctgttttgagggctgtgagtgcgacgaccgtttcctgctttcccagggtgtctgcatccctgtccaagattgtggctgcacccataatggccgatacttgccggtgagtagggacttggggtgggcagagagggtagaagagcttgggagagacccagagattctgtgctgacctcttcaaggctggggacagaggaggtaccgccatatcccagctatgtgacttgatgcaggcaacctccccctattagtctcctgcagcttctgtaaccaattaccgcagacatggtagcttaaacaggagaaattcattctcccacagttctgaaggccaaaagtcagaaatcaggaatactgggctgacatcaaggtgttggcaaggtggcactccct

SEQ ID NO: 23740 - DNA, 455 bp, Homo sapiens
agccgggtcagacagagcagagtggtgctggtggcaaggagaacagagggagaagcacagcggggaggacacctggggatctggggtgccagattgggtccagggggttataacagagaagagagaatttaacagggagagcagaggaggcgcatagatgggagaagaggcagaaatctatggagattgaggacgatctaaagattggggagaaggaccaacaggaggttaaataagttgcaaggatggagcccagctaatttttgtatttctagtagagatagggtttcaccatgttggccaggttggtctcaaactcctgacctcagataatccacccacctccacctcccaaagtgctggaattacaggtgtgaaccacctcagctgtccacccatgtatttcttgattgaaataatttgcttatgtcttggttctacagctgaccctgttt

SEQ ID NO: 23741 - DNA, 637 bp, Homo sapiens
aatgagaagggtttacaccttggggagacagaggcagatttggtattaagctgggccacaggggatggagacgttctgggtgtttaggggaggaggccgtgcccgggtctgtgtgatgtcagctatagcccaggtgggtgcatctggggggcctgacaagggtgacaataggggctgtgtctcagtctatggaaaggggctttgaactggggacatgagagggcctatttttaactgaaaccaaagaactgaggtttgagaaagaacaaagggaaaaggagagagggccccatggcggggatggggggtccccgaagcctcaccgtgagtgccaggcagtgtcgggcgcatgcggccttatgcagtgcggtcatgccatcccgggcccggaagtcaatgtgggccccgcccaggcacagggttcgaatcacctctacagagccttcggtctgggccgccagtgtcaagggggtctctgaagggcgggaaaagctggtcacatgaagccccttctcctcccctccatcccttcccattttccaggctctgcagctctccaccccacagcctctggccccgtggcctcccccttggacagcaatgtgtttgggagacaccagtcaggaatggatgtgaa

SEQ ID NO: 23742 - DNA, 327 bp, Homo sapiens
agccgggtcagacagagcagagtggtgctggtggcaaggagaacagagggagaagcacagcggggaggacacctggggatctggggtgccagattgggtccagggggttataacagagaagagagaatttaacagggagagcagaggaggcgcatagatgggagaagaggcagaaatctatggagattgaggacgatctaaagattggggagaaggaccaacaggaggttaaataagttgcaaggatggagcccagctaatttttgtatttctagtagagatagggtttcaccatgttggccaggttggtctcaaactcctgacctc

SEQ ID NO: 23743 - DNA, 542 bp, Homo sapiens
ttcccgctcactcctctccctccacacctccctgcaagctgagggagccggctctggccttggccagcccagaaaggggctcccacagtgcagcggtgggctgaagggctcctcaagtgccaccaaagtgggagcccaggcagaggaggcgccgagagcgagcgagggctgtgaggactgccagcacgctgtcacctctcaccaggaggtcaccatattgatgccagacttagtgtggacaccccactggcatagcgcactacagcccggaactcctgggctcaatccaccctctgggctcaagcagtcctcttgccacagcctcccaagtagctgggactacaggtacacgcttctgtgcctggctccacaggcagccccgaaatccttcagactgctgcccgtgttctcttgtctcctttctccctttcttcacggaacactgcaagccccacacaagtctcctcattcctatccctcctgggaattgtgcccatcatggagtcagccctggtccctcatgcacagaagccctgcccact

SEQ ID NO: 23744 - DNA, 498 bp, Homo sapiens
agccgggtcagacagagcagagtggtgctggtggcaaggagaacagagggagaagcacagcggggaggacacctggggatctggggtgccagattgggtccagggggttataacagagaagagagaatttaacagggagagcagaggaggcgcgtagatgggagaagaggcagaaatctatggagattgaggacgatctaaagattggggagaaggaccaacaggaggttaaataagttgcaaggatggagcccagctaatttttgtatttctagtagagatagggtttcaccatgttggccaggttggtctcaaactcctgacctcagataatccacccacctccacctcccaaagtgctggaattacaggtgtgaaccacctcagctgtccacccatgtatttcttgattgaaataatttgcttatgtcttggctctacagctgaccctgtttccctgttttcaaggtcaagagctgtgtgtttacactgctgcat

SEQ ID NO: 23745 - DNA, 429 bp, Homo sapiens
gggcggtgcccttacccactggtccctccctgcctggtgtcttcggagccctagctcacccggaacgttactgcccgcctgtgacagcgagaggaccaaagagggcagcgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggcccccccctggtcctttaagacaggtttggccaggctgattttgactggtaggcccaaaggaaagcctcaagggcagaccaaactccgacaggctccgagattaaggctttcaaacgtctgatcgttttcagcttggtcagtaaaatcgatcccgcctttatcaggagattcctttgtcaaag

SEQ ID NO: 23746 - DNA, 438 bp, Homo sapiens
ctttagctctttgcaataaatcttgctgctgctcactctttgggtccacactgcctttatgagctgtaacactcactgcgaaggtctgcagcttcactcctgaagccaacgagcccacgaccccaccgggaggaacgaacaactccatacgtgccgacttaagatctgtaacactcatcgcaaaggtctgaaacttcactcctgagccagcgagaccacgaacccaccataaggaacaaactccgaacacattcgaacatcagaaggaacaaactccggacatgccacctttaagacctgtaacactcaccacgagggtccgcggcttcattcttgaagtcagtgagaccaagaacccaccaattccggacacaaaaatatatgaagcaggctgggcgcggtggctcatgcctgtaatcctaacactttgggaggctg

SEQ ID NO: 23747 - DNA, 610 bp, Homo sapiens
  misc_feature 74, 504: n = A,T,C or G
cagaagggtggtggcttgtgtgagtcaggctccttcagttgcacagtacaagatcaaaactcaaacttgtttangcacataaagggagtttaggtgtttcatctgtttgggatcctgtaataaaatatcacagactgataccttgtaaatagcaatttatttctcacagttttgaaggctggaaagtccaagatcaaggcaccaacagatttggtgtctggtgagggcttgcttcctggtttgtagatggctgtcttttcactaaccttatatggtagaaaaagactagctagctgtctagggtctctcataaaattactaatcccattcatgagtgtgtaaccctaatgacttaatcatctcccaaaggtcccaccttctaataccatcgccttagtgattaggttttaacatatgaattttgagggtgaggaggacaagcacattcagaccatagcaattgccttaataaagtaggagctccctaagtacccctggctttangcatgtttgtaactaaaggttgacacaacatccatttctttctgctctttgacctcattttctctatgtgggctttcttctccagcagaacgaccctaccgactgc

SEQ ID NO: 23748 - DNA, 546 bp, Homo sapiens
  misc_feature 133: n = A,T,C or G
ggcgtgagccaccgcatctggccctccctttctatttcttcaagacctttttcggatccctcctgcgcaggacctaaacgggcggtgcccttacccactggtccctccctgcctggtgtcttcggagccctanctcacccggaacgttactgcccgccggtgacagcgagaggaccaaagagggcagcgggtgcggtgggaaccacagagtcaccgcgcacctgcgcctcgcaggctcctcgcaaattgaataaacgccccctgaagcttctcttcaagtcacagggaaggggaagatggctgccgacccggcgggagaagccagccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatcccgcctttatcaggagattcctttgtcaaagttcaaagacctggggttcccgctgcttgccacacaga

SEQ ID NO: 23749 - DNA, 483 bp, Homo sapiens
  misc_feature 443: n = A,T,C or G
tctgctgctgctcactctgggcccccactgcctttatgagctgtaacactcaccacgaaggtctgcggcttcactcctgaagccagcgagaccacaaacccactgggaggaaggaacaactccagacgcgctgccttaagatctgtaacactcactgtgaagctctgcagcttcactcctgagccagcgagaccatgaacccaccagaagtaagaaactccaaacatatccgaacatcagcagtagcaaactccggacacgccgcctttaagaattgagaattgtaacactcacggcgcgggtccgcagcttcattcttgaagttggtgagaccaagaacccaccaattccggacccagctgtcttttgggcattgtccggaaggccggctgtagtattctgcctacagatacttgtcaagtgctcatggacagaagtcgtanttggggaggatggctgcaaaggcacaatgacatttggctt

SEQ ID NO: 23750 - DNA, 482 bp, Homo sapiens
ctaacactgcaggactcagcaggactatttaagaaacaactgaggcatcagaccaactttccccacaagtcctcggatctttcctgccatgctgatgccatatattccaacgtgatcaacctggctccccagaaggaggacgactttgctgtctacaccaacatgcccccttttcatcaccccaggaggacattgccagaccaagtggaatatgtctccattgtattccactgatgggaagctaatgagatgctcagagtgggggtcagacctggccccagctgaatcttggcataccctttgctttagatttatgtgtgtgtttaaaaaaaaaaaaaatacataggccaggcacgggggctcacacctgtatcccaccactttgggaggctgaggcaggcaaatcaccaggtcaagaaatcaagaccatcctggccaacatggggaaaccccgtctctactaaagatacaaaaattaccca

SEQ ID NO: 23751 - DNA, 496 bp, Homo sapiens
  misc_feature 53: n = A,T,C or G
gggagaagcagttgtattacaaggtggaccaatggctccttctgagggtttangatggctgactagaggagagcgggggtggaggtcctctctccggtggatgaacctgcaagatgaaatagccagaagctaggctgggcatggtggcttacgcctgtaatctcagaactttgggaaaccgagatctcgatgggataaccacattggtttgtttagtaaacactgagaccaactccaccatccagaggcctgacagacaaatggcctgagacagggctgggaaagttttgcttctggttgggacttcaggaagagttttgttttgttttgttttcccccaagggaacaagcccttgaatccgggaggccaaggttgcggtgaaccgagattgcgccattgcactccagcctgggcaacaagagcgaaactccgtctcaaaaacataaaaagtaaaaaagatatgtacgtcaatgtcagactttctgtgctggatgg

SEQ ID NO: 23752 - DNA, 573 bp, Homo sapiens
  misc_feature 445: n = A,T,C or G
ggtggctgagacatcgagtctatattttggggcaaaaactaaacggcagcacaaaaggaaatctatattaatagaatattttgttgaacaaaggaggttagataagaactgcaaaccaacagactcagcaaacaaggaaagaaacgtgttagccataagacatgtttcaagtgaatcgaagtccaataactgtagacttcagaagaaaaaagttttcaaaaattttatcaaaacaggtcactgataaataactcctccagtaatagagctaggcctgaaaccaaaattaattaaaaaattaacaaaacagattgaacctgaattaaatttcttttgataaaaaaacttattaaaaataatcaaaattttcctcaaatttttattaccttgtccaaagtaaagcaagtgtcttttaacattcatgccagcttttctcatgttctangaatgacagaaaccttacttgaagcaaactagtatttttgttgaaaatgtatatcagcatcagttaaagttgatttttcagacctgctcctcagtaataatactagctagtcagcattcacgcctacc

SEQ ID NO: 23753 - DNA, 408 bp, Homo sapiens
agggcagggttttaccatgttggccaggctggtctcaaactcctgacctcaggtgatccacctaacttgccctctcaaagagctgggattacaggaatgagccaccacatccaccctaattatggttattaagttattgtagaccacagaaataaccaaatttccttatcaattgtctttaactataactatttaaagtcatttccacagttaattgcttaatggtgatgcagtttctaaaaacttcacaagcatgcaaaattctagaatagaagattcatgaaagaatgaaaaggaccatgaaaaacactcgggaacacaggtttctaataactttaatatcatgggtaaaaattccccataagttccccgatcccccaataattggactggttaagaattctcaaa

SEQ ID NO: 23754 - DNA, 366 bp, Homo sapiens
gacagaagggtattgtactattataatgagattatgggaacattccactgcatttgtggcagatgaatgtataatagcataggaatccagataatttgaagatatatgagtcctgcattttggagctggccaaaagtttgattatttgccagaaacctgtgagtgggcgtagcatttagacagggacctttattccagagtagccctggtttaatctggcatgttggcgaaagtacatactacacatacatctgtgtatgttaatttcttctaatctcatattttctatttagacttttaataattccctaaaataactatttcagttgatatttactcagtggcctaacttgaatcctatgactc

SEQ ID NO: 23755 - DNA, 493 bp, Homo sapiens
gacagaagggcagcccaaggagtctcctgttacaggtcagggagctgaatccctgtttgcaaaacacagcctgagctccgttcacttcctgctgtccctgcccctaggaatgtaggctcagggagtactccccaggcgacctgtggttacagagtggtcagctgggggagaggaggtggagggtgtctgaccctgggctgggaggcaggtgcacttcggtgtcggatggggctcctgccctgatggcatcttctgtgctggtggtgggacgcctagacacttcccaaagaagaggcccctacgaacccagagttgtgaatgtgagggtgttggagagctgccacagctgtggggcccgctgaggggagcagaggaggagggggtgaggagctgacaaaggaggcgcagggcagcagggtggtgcacccaggtgggagcagcaagtgcaccatgcacaggccctggcacacaatagactctcagcacagctgcc

SEQ ID NO: 23756 - DNA, 406 bp, Homo sapiens
gacagaaggggcgggtgtggtgggaaccacagagtcaccgcgcacctgcgcctcgcgggctcctcgcaaattcaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatcccgcctttatcaggagattcctttgccaaagttcagagaactggggttcccgctgcttaccacacagaaaaccgatcactgagacggttattgccaaggaagag

SEQ ID NO: 23757 - DNA, 614 bp, Homo sapiens
acagaagggggatatgacaccccttgacctcttaatatttcagtgtatttcctagaagcgaatgcattatcctatatagtcacagtgcctgtaaccacaccaggaagttagtattgccaccaggcctcacactgtgtgcagtgatgtttcacaggctcacccactgtatatagtgatatttctagtccccttcagtcaggaacggtcccttgcctttctgtctttcctgaccttgacccctccagagcatgtggccgccccttaggctgtctggtatttgctggtgactaggcccagcatgggctttgttgggaggagcaccgtagtgggacacctggtcctttccaggtgcccttttatcaccgggttaaaaaggtgccggtcaggtttttccattgtaaaataattactttgtgcccagattaaatagtaatgaggctgggcgtggtggttcatgcctgtaatcccaggactttgagaggctgaggtgggcggatcactggagctcaggagtgtgagaccagctcaggcaacatagcaaaatcccatctctaccaaaaatttaaaaataaccaggtgtgggtggtgtgcgcctgtaatcccagctacttgag

SEQ ID NO: 23758 - DNA, 516 bp, Homo sapiens
acagaagggacactctcctgaatagggttagctaccttttcttctttctagccctcttcttttgccgttttcttaccagttcttttttcttgaattatacattaattaattcaattggtaaagtattctgctcctgtctttcacaccttaaatcatcattcctcccaacgtggattaactaacatcacagttacttagagctttgatgcaaatacaagtgccaggccactacatcacgcgtacacatttagaacatctagagtgagaccatgggtctacatattcaacgagacccttcaagtgttattttaggtatcacaaagtaggaagcactgataaaggaaacctttaaacatatacacacacacattttatttgcttttcctttctccccaaaattcagccatgattttacttacctcgttagtggttcagaagataagtatgtttatatctggagtacctaccatgacctaagcaagtttacttcagtcaggagagatcgtaatgacttct

SEQ ID NO: 23759 - DNA, 593 bp, Homo sapiens
  misc_feature 411: n = A,T,C or G
gggatctgccagttggtatgaggaggccctgaatgatgacatcagaattctaaatattctggatgtactcgtctcaacttttcctctccagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggtgagagcatcctcccagccctcccacaagggccacttttggttctcaggtcacatgacacagcacagcatgtttcctccacaggtgggaacatgtgtcgaggagggctatttgcaaaccaatccagacggtcaaaggggtctttcagaggagtcttttaaagactggtcctangctggatgcagtggctcatgcctgtaatcccagcactttgggaggccaaggcaggtagatcacctgaggtcgggggttcgagaccagcctggccaacatggtgaaaccccgtctctactaaagatacaaaaaattagccgggtgtggtggtgtgcacctgtagtcccagctactccggatgc

SEQ ID NO: 23760 - DNA, 444 bp, Homo sapiens
gtaaacagagagcacaattttttgttttaatagcagcattccttgttataataaatattaaaataacaccataataaaatcactaatgatgtaacctaattgtgctgatttcacagagggtggaaaacatcagcccaggggtgggactactgtgtttatataatacaaacacctgaaggtggcagaaactagcagagacagaggatttcttagcatcagaattgatatgttgttatttatgatctcttaataatttagaggcatataataatgacaaggattctgatatttgttataaagtataattgtgttgattatatttaaaaccattaatagaaacaatataattatagaattaagtaaaactgtaagtggtatgctatggcatggtgtacggtatggtgcggtatgaggaatgtggagtaaagtgtggtggggaggtgt

SEQ ID NO: 23761 - DNA, 129 bp, Homo sapiens
gggagggttcgattccggagagggagcctgagaaacggctaccacatccaaggaaggcagcaggcgcgcaaattacccactcccgacccggggaggtagtgacgaaaaaaaaaaaaaaaaaaaaaaaac

SEQ ID NO: 23762 - DNA, 434 bp, Homo sapiens
  misc_feature 94, 252: n = A,T,C or G
gattctacagaattaagttagcagtaaggtgataatacctggcatagtatggtggctgagtaaggaaaggatataagtcatttcaaagaattangcctggttactgacaatagggcatgaacaaaagggatgaattcaagatggctttaagcctgcttggaagatgtaggtgacattggcagcgaggcaaatcagtgttaggtctcagcttctaattcgagtggccctattaatctagggagtacactctanggaaggtggtatgtggtagaatagaggctttggaattggacaacataggctttagaattggacagaaatggtttccaatccattggctgtgtgattgagcaaactgcttaatttctctgagccttatttactaatgtgtaaaatgagaacttaatgagatgagatttcattatttctctcca

SEQ ID NO: 23763 - DNA, 509 bp, Homo sapiens
acagaagggaatatgacattccaaagccttcgtaatgttacaggatctctggggtgttgtttttctggctggaaatctgtggctgttggcgccttggcccgagttttgcccgtttccactgaggaaaaggagtcatctcgtatgtccactgtccagaatctccactcttccacccctttgctgatttaagtaagagtgatgacctgctccctgcaggcactgaggaatacatccatgcaaggatttaacagagaaatgacaggaaaacccttagcactgtctaagcgatcactaaggattacaataaaaagcaactagtgaaggcatttaagaggaaatttccctgcaatgggacggtaattgagcatccagaatatggagaagtcattcagctacagggtgaccagcgcaagaacatatgccagttccttgtagaggtgggactggctaaggacgatcagctgatggttcaagggttttaactacttgtggctcactgaaacttaagt

SEQ ID NO: 23764 - DNA, 627 bp, Homo sapiens
ggagaaggtctgcagcttcactcctgagccagcaagaccacgaacccaccagaaggaagaaactccgtacacatccgaatatcagaaggaacgaactcctgaaacgtcgcctttaagaactataacactcactgcgagggtccgtggcttcattcttgaagtcagtgagaccaagaacccaccagacacactaagactaggtaatttataaagggaagaggtttaattgactcacacttccacatcgctggggagacctcacaatcatggtaaaaggtgaatgaggagcaaagtcctgtcttacatggtggcagggaagagagcttgtacagcgagctctcatttgtaaaagcctcagatcttatgagacttactcactaccaggagaacagtatgggagaaaccacccccatgattcagttatctgcatgtggccccgtccttgccatgtggggattattacaattcaaggtgagatttggctggggacacagccaaaccatattaactaatgcactgcatgagtctgtacctcctttgaggtctaaaaattaagcaactttctcagggttatacaactgaacgtattctcagtctctctatgcttcccaattatctgggatacta

SEQ ID NO: 23765 - DNA, 618 bp, Homo sapiens
acagagggggccggaccatggcgcaggggcagcgcaagtttcaggcgcacaaacccgcaaagagtaagacggcagcggcagcctctgaaaagaatcggggcccaagaaaaggcggtcgtgttatcgctcccaagaaggcgcgcgtcgtgcagcagcaaaagctcaagaagagacggggtttcaccgtgttcgccgggatggtctcgatctcctgacctcgtgatctgcccgcctcagcctcccaaagtgctgggattacaggcgtgagccaccacgcccggcaggataacatcttaacatacatcccggagttgtctttcagagcttggaaccccactgaggacccccgctgaacagatccattcactggcacagactcctagataaggaagaagtgaagactaaacttgacctttgttctgtttcttccttgggggattagagaaagtcactccctgtaaccagttatttttctactgacccctgtcaggcctctgagcccaagcctgcacgaatacatccagatggcctgaagcaagtgaagaatcacaaaagaagtgaaaatagctggttcctgccttaactgacattaccttgtgaaattccttttcttggctc

SEQ ID NO: 23766 - DNA, 521 bp, Homo sapiens
gaattacatttcaacatgagatttgggcgggggacaaatatccaaactatgtcacggagcaagaggaggtccctggagctgttgaagcagaaatggggtgaagaatagaggtggagggtgcttaggcttccaaggtctcttctaggtgtgagatggagggattctgcgaccaagtcacctggagagtgactcaacaaggtgactgctttcccaagcacgagccctcgggggacagacgggggctgaaaactggcacacattcttcctggatcctttgacatgtgatcattcaaagataacagttcaaagataacaaagggattgaagctttaccaatccctttcttattgtggcattttctctattaaaaataaatactcatttatactataacttacagaatcagtaccaattctgaaagtatacaaagcgttgccttactttaaggaaggagaccactactactcctgctgccctcctcccccgaccttgcctagttcacaagacaggaggaaagagag

SEQ ID NO: 23767 - DNA, 394 bp, Homo sapiens
caacgttgacagtaatgaacaaggctcctatgtagtggccatggaaacctttaccaacttaggacccattgtcgatatgtgcgtggtggacctggagaggcaggggcaggggcaggtaagggccattctgaaagtggatagttggtatatgcccactcaaactgtgtcctcctagctatgcttatctagaatggggagggtgcactgaaaatacttttaagagccccctcatgaatcccagtgatataaggataactactgtttattgagtgcctatcttggtctgccaggcactttatatacattatctctaattacacaagtaccctagatagggatatttggccatctcagaagtgaggaaaattagggctgagaaagattaagtaacttt
